(12) United States Patent
Hewezi et al.

(10) Patent No.: US 10,457,956 B2
(45) Date of Patent: Oct. 29, 2019

(54) SCN PLANTS AND METHODS FOR MAKING THE SAME

(71) Applicant: UNIVERSITY OF TENNESSEE RESEARCH FOUNDATION, Knoxville, TN (US)

(72) Inventors: Tarek Abdelfattah Hewezi, Ames, IA (US); Aditi Rambani, Knoxville, TN (US); C. Neal Stewart, Jr., Knoxville, TN (US); Mitra Mazarei, Knoxville, TN (US); Vincent Pantalone, Knoxville, TN (US)

(73) Assignee: UNIVERSITY OF TENNESSEE RESEARCH FOUNDATION, Knoxville, TN (US)

( * ) Notice: Subject to any disclaimer, the term of this patent is extended or adjusted under 35 U.S.C. 154(b) by 71 days.

(21) Appl. No.: 15/540,580

(22) PCT Filed: Dec. 30, 2015

(86) PCT No.: PCT/US2015/067989
§ 371 (c)(1),
(2) Date: Jun. 29, 2017

(87) PCT Pub. No.: WO2016/109619
PCT Pub. Date: Jul. 7, 2016

(65) Prior Publication Data
US 2017/0369900 A1 Dec. 28, 2017

Related U.S. Application Data

(60) Provisional application No. 62/099,035, filed on Dec. 31, 2014.

(51) Int. Cl.
*C12N 15/82* (2006.01)
*A01H 1/04* (2006.01)
*C12Q 1/6895* (2018.01)

(52) U.S. Cl.
CPC ........... *C12N 15/8285* (2013.01); *A01H 1/04* (2013.01); *C12Q 1/6895* (2013.01); *C12Q 2600/13* (2013.01); *C12Q 2600/156* (2013.01); *C12Q 2600/178* (2013.01); *Y02A 40/164* (2018.01)

(58) Field of Classification Search
CPC .......... C12N 15/8285; C12N 2310/141; C12N 15/8218; C12N 15/113; C12N 2310/14; A01H 5/10
See application file for complete search history.

(56) References Cited

U.S. PATENT DOCUMENTS

| | | | |
|---|---|---|---|
| 5,491,081 A * | 2/1996 | Webb | A01H 5/10 800/267 |
| 6,096,944 A * | 8/2000 | Vierling | A01H 5/10 435/6.11 |
| 7,208,657 B1 * | 4/2007 | Lindenbaum | A01H 5/10 435/415 |
| 2009/0070898 A1 * | 3/2009 | Allen | C12N 15/8216 800/286 |
| 2010/0275286 A1 * | 10/2010 | Wu | A01H 1/02 800/260 |
| 2013/0337442 A1 | 12/2013 | Shendelman et al. | |
| 2013/0340115 A1 | 12/2013 | Daines et al. | |
| 2014/0007295 A1 | 1/2014 | Huang et al. | |
| 2014/0317780 A1 * | 10/2014 | Allen | C12N 15/8216 800/285 |

FOREIGN PATENT DOCUMENTS

| | | |
|---|---|---|
| EP | 2 633 057 | 9/2016 |
| WO | WO 2012/058266 | 5/2012 |
| WO | WO 2013/188501 | 12/2013 |
| WO | WO 2013/188612 | 12/2013 |

OTHER PUBLICATIONS

Gao, Peng, et al. "Over-expression of osa-MIR396c decreases salt and alkali stress tolerance." Planta 231.5 (2010): 991-1001 (Year: 2010).*

Ni, Zhiyong, et al. "Overexpression of gma-MIR394a confers tolerance to drought in transgenic *Arabidopsis thaliana*." Biochemical and biophysical research communications 427.2 (2012): 330-335 (Year: 2012).*

Yang, Chunhua, et al. "Overexpression of micro RNA 319 impacts leaf morphogenesis and leads to enhanced cold tolerance in rice (*Oryza sativa* L.)." Plant, cell & environment 36.12 (2013): 2207-2218 (Year: 2013).*

Sunkar, Ramanjulu. "MicroRNAs with macro-effects on plant stress responses." Seminars in cell & developmental biology. vol. 21. No. 8. Academic Press, 2010 (Year: 2010).*

Li, Chao, and Baohong Zhang. "MicroRNAs in control of plant development." Journal of cellular physiology 231.2 (2016): 303-313 (Year: 2016).*

Navarro, Lionel, et al. "A plant miRNA contributes to antibacterial resistance by repressing auxin signaling." Science 312.5772 (2006): 436-439 (Year: 2006).*

Chiou, Tzyy-Jen, et al. "Regulation of phosphate homeostasis by microRNA in *Arabidopsis*." The Plant Cell 18.2 (2006): 412-421 (Year: 2006).*

Cook, D. E. et al. "Distinct Copy Number, Coding Sequence, and Locus Methylation Patterns Underlie Rhg1-Mediated Soybean Resistance to Soybean Cyst Nematode" *Plant Physiology*, Jun. 2014, pp. 630-647, vol. 165.

Joshi, T. et al. "Prediction of novel miRNAs and associated target genes in *Glycine max*" BMC Bioninformatics, Jan. 18, 2010, pp. 1-9, vol. 11, Suppl. 1, S14.

(Continued)

*Primary Examiner* — Weihua Fan
(74) *Attorney, Agent, or Firm* — Saliwanchik, Lloyd & Eisenschenk

(57) ABSTRACT

The invention relates to genes which may be utilized for resistance to soybean cyst nematode. More specifically the present disclosure relates to identification of gene(s) that can confer upon a soybean plant resistance to soybean cyst nematode (SCN) and methods to use these loci and genes to obtain soybean strains that are resistant to SCN.

16 Claims, 11 Drawing Sheets
Specification includes a Sequence Listing.

(56) References Cited

OTHER PUBLICATIONS

Klink, V. P. et al. "Emerging Approaches to Broaden Resistance of Soybean to Soybean Cyst Nematode as Supported by Gene Expression Studies" *Plant Physiology*, Nov. 2009, pp. 1017-1022, vol. 151.
Mazarei, M. et al. "Gene expression profiling of resistant and susceptible soybean lines infected with soybean cyst nematode" *Theor Appl Genet*, Jul. 29, 2011, pp. 1193-1206, vol. 123.
Rambani, A. et al. "The Methylome of Soybean Roots during the Compatible Interaction with the Soybean Cyst Nematode" *Plant Physiology*, Aug. 2015, pp. 1364-1377, vol. 168.
Xu, M. et al. "Novel MiRNA and PhasiRNA Biogenesis Networks in Soybean Roots from Two Sister Lines That Are Resistant and Susceptible to SCN Race 4" PLOS One, Oct. 2014, pp. 1-20, vol. 9, No. 10.
Written Opinion in International Application No. PCT/US2015/067989, dated May 24, 2016, pp. 1-7.

\* cited by examiner

SCN PLANTS AND METHODS FOR MAKING THE SAME

CROSS-REFERENCE TO RELATED APPLICATIONS

This application is the U.S. national stage application of International Patent Application No. PCT/US2015/067989, filed Dec. 30, 2015, which claims the benefit of U.S. Provisional Application Ser. No. 62/099,035, filed Dec. 31, 2014, the disclosures of which are hereby incorporated by reference in their entirety, including all figures, tables and amino acid or nucleic acid sequences.

The Sequence Listing for this application is labeled "Seq-List.txt" which was created on Dec. 24, 2015 and is 961 KB. The entire contents of the sequence listing is incorporated herein by reference in its entirety.

FIELD OF THE INVENTION

This invention relates to genes which may be utilized for resistance to soybean cyst nematode. More specifically the present disclosure relates to identification of gene(s) that can confer upon a soybean plant resistance to soybean cyst nematode (SCN) and methods to use these loci and genes to obtain soybean strains that are resistant to SCN.

BACKGROUND OF THE INVENTION

Soybeans (Glycine max) are a major cash crop and investment commodity around the world. Soybean oil is one of the most widely used edible oils, and soybeans themselves are used worldwide both in animal feed and in human food production.

Soybean cyst nematode (SCN) causes substantial yield loss in North American soybean. *Heterodera glycines Ichinohe*, was first identified on soybeans in the United States in 1954 at Castle Hayne, N. C. Winstead, et al., Plant Dis. Rep. 39:9-11, 1955. Since its discovery the soybean cyst nematode ("SCN") has been recognized as one of the most destructive pests in soybean in the United States and worldwide. It has been reported in nearly all states in which soybeans are grown, and it causes major production problems in several states, being particularly destructive in the midwestern states. See generally: Calwell, et al., Agron. J. 52:635-636, 1960; Rao-Arelli and Anand, Crop. Sci. 28:650-652, 1988; Baltazar and Mansur, Soybean Genet. Newsl. 19:120-122, 1992; Concibido, et al., Crop. Sci., 1993. For example, susceptible soybean cultivars had 6-36% lower seed yields than did resistant cultivars on SCN race-3 infested sites in Iowa (Niblack and Norton 1992). Since the discovery of SCN in the United States in the 1970s, extensive efforts have been made to identify new SCN resistance sources by screening Glycine max plant introductions (PIs) of the USDA soybean germplasm collection (Anand et al. 1988; Arelli et al. 2000; Arelli et al. 1997; Young 1995). Chen et al. (2006) used bioassay to characterize over 120 SCN resistance soybean accessions with SCN races 3, −5, and −14 and reported many PIs including PI 437654, PI 438489B, PI 90763, PI 89772, PI 404198A, and PI 567516C with high resistance levels to multi-races.

Although several SCN resistance quantitative trait loci (QTLs) have been discovered in PI 437654 (Concibido et al., 2004, U.S. Pat. No. 6,096,944 issued to Vierling et al. and U.S. Pat. No. 6,538,175 issued to Webb), many SCN resistance QTLs remain to be identified. More SCN sources of resistance have been evaluated extensively to identify novel QTLs and epistatic effects between QTLs (Wu et al 2009). Among soybean PIs evaluated for SCN resistance, PI 437654, PI 467312, PI 438489B, and PI 567516C have been reported to be highly resistant to multi-races (also known as HG types) of SCN. In addition, PI 567516C is also resistant to a synthetic nematode population LY1 and genetically unique from most other SCN resistant sources, including Peking and PI 88788 that are widely used in current SCN resistant varieties.

SCN accounts for roughly 40% of the total disease in soybean and can result in significant yield losses (up to 90%). SCN is the most destructive pest of soybean to date and accounts for an estimated yield loss of up to $1 billion dollars annually. Currently, the most cost effective control measures are crop rotation and the use of host plant resistance. While breeders have successfully developed SCN resistant soybean lines, breeding is both difficult and time consuming due to the complex and polygenic nature of resistance. The resistance is often race specific and does not provide stability over time due to changing SCN populations in the field. In addition, many of the resistant soybean varieties carry a significant yield penalty when grown in the absence of SCN.

Although the use of nematocides is effective in reducing the population level of the nematode, nematocide use is both uneconomical and potentially environmentally unsound as a control measure in soybean production. Neither is crop rotation a practical means of nematode control, since rotation with a nonsusceptible crop for at least two years is necessary for reducing soybean losses. Therefore, it has long been felt by soybean breeders that use of resistant varieties is the most practical control measure.

Screening of soybean germplasm for resistance to SCN was begun soon after the discovery of the nematode in the United States, and Golden, et al. (Plant Dis. Rep. 54:544-546, 1970) have described the determination of SCN races. Although SCN was discovered in North America about 40 years ago, soybean breeding for resistance to SCN has mostly utilized genes from two plant introductions—Peking and PI88788, and while these lines have resistance genes for several SCN races, including race-3, they do not provide resistance to all known races.

The plant introduction PI 437.654 is the only known soybean to have resistance to SCN races-3 (Anand 1984) (Anand 1985) and (Rao-Arelli et al. 1992b). However, PI 437.654 has a black seed coat, poor standability, seed shattering, and low yield, necessitating the introgression of its SCN resistance into elite germplasm with a minimum of linkage drag. Conventional breeding with PI 437.654 produced the variety 'Hartwig' (Anand 1991), which is more adapted to cultivation and can be used as an alternative source of SCN resistance in soybean breeding programs.

Resistance to SCN is multigenic and quantitative in soybean (Mansur et al. 1993), though complete resistance can be scored qualitatively. For complete resistance to SCN, PI 437.654 has two or three loci for race-3, two or four loci for race-5, and three or four loci for race-14 (Myers and Anand 1991). The multiple genes and SCN races involved contribute to the difficulty breeders have in developing SCN resistant soybean varieties.

Breeding programs for SCN resistance rely primarily on field evaluations where natural nematode populations occur. However, these populations can be mixtures of undetermined races (Young 1982) and the environment can affect the overwintering and infection capability of the nematodes (Niblack and Norton 1992). Although evaluations using inbred nematode populations in controlled greenhouse environments are superior, they are prohibitively expensive and the nematodes are difficult to manage for large breeding programs (Rao-Arelli, pers comm). These deficiencies in each evaluation method make SCN resistance a difficult trait to manipulate in soybean improvement programs. Host plant resistance is an effective approach to control this pest; however, continuously growing the same resistant cultivar (s) may result in SCN population shifts and loss of SCN resistant phenotype.

Therefore, discovery of new sources of genetic resistance is fully warranted.

SUMMARY OF THE INVENTION

The present invention includes methods for detecting SCN resistance in a plant, comprising the steps of: (a) measuring expression level of a gene in a sample taken from the subject, and (b) comparing the expression level obtained in step (a) with a standard control, wherein a decrease in the expression level of the gene when compared with the standard control indicates the plant has SCN resistance. Such methods can include syncytium regulated genes or miRNA genes.

Additional embodiments of the invention can include methods for detecting SCN resistance in a plant, comprising the steps of: (a) treating a sample taken from the subject with an agent that differentially modifies methylated and demethylated DNA; and (b) determining whether each CpG in a CpG-containing genomic sequence is methylated, demethylated and/or hypomethylated, wherein presence of one methylated CpG in the CpG-containing genomic sequence indicates the subject having increased SCN resistance. The CpG-containing genomic sequences can comprise one or more CpG containing sequences.

Other embodiments include methods for detecting SCN resistance in a plant, comprising the steps of: (a) treating a sample taken from the subject with an agent that differentially modifies methylated, demethylated and/or hypomethylated DNA; and (b) determining whether each CHG in a CHG-containing genomic sequence is methylated, demethylated and/or hypomethylated, wherein presence of one methylated CHG in the CHG-containing genomic sequence indicates the subject having increased SCN resistance.

Embodiments can also include methods for detecting SCN resistance in a plant, comprising the steps of: (a) treating a sample taken from the subject with an agent that differentially modifies methylated, demethylated and/or hypomethylated DNA; and (b) determining whether each CHH in a CHH-containing genomic sequence is methylated, demethylated and/or hypomethylated, wherein presence of one methylated CHH in the CHH-containing genomic sequence indicates the subject having increased SCN resistance. The present invention also includes elite soybean plants, or a part thereof, comprising one or more introgressed Soybean Cyst Nematode (SCN) resistance loci, wherein said elite soybean plant comprises one or more agronomic traits selected from the group consisting of herbicide tolerance, increased yield, insect control, fungal disease resistance, virus resistance, nematode resistance, bacterial disease resistance, mycoplasma disease resistance, modified oils production, high oil production, high protein production, germination and seedling growth control, enhanced animal and human nutrition, lower raffinose, environmental stress resistance, increased digestibility, production of industrial enzymes, production of pharmaceutical proteins, production of pharmaceutical peptides, production of pharmaceutical small molecules, improved processing traits, improved flavor, improved nitrogen fixation, improved hybrid seed production, reduced allergenicity, and improved production of biopolymers and biofuels. The elite soybean plant can be resistant to *Heterodera glycines*. In various embodiments, the elite soybean plant, or part thereof, of comprises one or more heterologous nucleic acid sequences encoding one or more miRNA selected from SEQ ID NOs: 1-37 one or more constructs comprising a heterologous promoter operably linked to a nucleic acid sequence encoding one or more miRNA selected from SEQ ID NOs: 1-37. Yet other embodiments provide an elite soybean plant that comprises one or more heterologous nucleic acid sequences encoding one or more gene selected from SEQ ID NOs: 38-315 or one or more construct comprising a heterologous promoter operably linked to a nucleic acid sequence encoding one or more gene selected from SEQ ID NOs: 38-315. Still other embodiments provide an elite soybean plant comprises one or more heterologous nucleic acid sequences encoding one or more miRNA selected from SEQ ID NOs: 1-37 and one or more heterologous nucleic acid sequences encoding one or more gene selected from SEQ ID NOs: 38-315 or one or more constructs comprising a heterologous promoter operably linked to a nucleic acid sequence encoding one or more miRNA selected from SEQ ID NOs: 1-37 and one or more construct comprising a heterologous promoter operably linked to a nucleic acid sequence encoding one or more gene selected from SEQ ID NOs: 38-315.

Additional methods of the present invention include methods of selecting at least one soybean plant by marker assisted selection of a quantitative trait locus ("QTL") associated with soybean cyst nematode resistance, wherein said QTL is localized to a chromosomal interval, said method comprising testing at least one marker on said chromosomal interval for said QTL and selecting said soybean plant comprising said QTL. The selected soybean plant can be used in a cross to introgress said QTL into progeny soybean germplasm.

Other embodiments of the present invention can include methods for generating a soybean plant, said methods comprising (a) introgressing SCN resistance into an SCN sensitive soybean germplasm, (b) determining the presence or absence of a marker gene or a fragment thereof and a transgene, said marker gene being selected from the group consisting of the polynucleotide molecules of specific sequences and (c) allowing the germplasm generated in (a) to develop into a soybean plant resistant to soybean cyst nematode (SCN) if the marker and transgene are present, wherein step (a) precedes step (b). In various embodiments, the soybean plant is introgressed to contain one or more heterologous nucleic acid sequences encoding one or more miRNA selected from SEQ ID NOs: 1-37 or one or more constructs comprising a heterologous promoter operably linked to a nucleic acid sequence encoding a miRNA selected from SEQ ID NOs: 1-37. Yet other embodiments provide a soybean plant that is introgressed to contain one or more heterologous nucleic acid sequences encoding one or more gene selected from SEQ ID NOs: 38-315 or one or more construct comprising a heterologous promoter operably linked to a nucleic acid sequence encoding one or more gene selected from SEQ ID NOs: 38-315. Still other embodiments provide a soybean plant that is introgressed to contain one or more heterologous nucleic acid sequences encoding one or more miRNA selected from SEQ ID NOs: 1-37 and one or more heterologous nucleic acid sequences encoding one or more gene selected from SEQ ID NOs: 38-315 or one or more construct comprising a heterologous promoter operably linked to a nucleic acid sequence encoding one or more gene selected from SEQ ID NOs: 38-315 and one or more constructs comprising a heterologous promoter operably linked to a nucleic acid sequence encoding a miRNA selected from SEQ ID NOs: 1-37.

Additional embodiments of the present invention include methods of selecting a population of plants or seeds with SCN resist comprising the steps of: a) providing a population consisting of a plurality of individual plants which are genetically uniform; b) isolating a tissue sample or explant from individual plants of said population in a manner which allows further cultivation of said sampled individual plants; c) determining the SCN resistance of said individual plants by analyzing said sample of said plants; d) selecting a number of plants wherein said sample exhibits resistance to SCN from said population; e) growing the selected plants and propagating from each of the selected plants a line of cloned progeny plants; f) determining the SCN resistance for each line of cloned progeny plants; g) selecting a line of clone plants wherein said SCN resistance is higher than the average of the SCN resistance of all lines of cloned progeny plants; h) growing a population of individual plants from said selected line of clone progeny plants; and i) repeating at least once steps b to h on said subsequent population. The SCN resistance can be determined by methods including a) determining the methylated regions in a plant; b) determining the hypo-methylated and hyper-methylated regions in a CpG, CHG or CHH context; c) comparing methylation levels of the genes in the syncytium to determine the SCN resistance potential of a plant.

Embodiments of the present invention also include methods for producing an SCN resistant soybean plant comprising: a. performing marker assisted selection to identify a soybean plant possessing a resistance allele of SCN resistance locus, wherein the SCN resistance locus is identifiable by one or more of the markers and generating a progeny of said soybean plant wherein said progeny possesses said resistance allele of SCN resistance locus and exhibits at least partial resistance to SCN. Such methods can comprise soybean plants that further comprise one or more traits selected from the group consisting of herbicide tolerance, increased yield, insect control, fungal disease resistance, virus resistance, nematode resistance, bacterial disease resistance, mycoplasma disease resistance, modified oils production, high oil production, high protein production, germination and seedling growth control, enhanced animal and human nutrition, lower raffinose, environmental stress resistance, increased digestibility, improved processing traits, improved flavor, improved nitrogen fixation, improved hybrid seed production, reduced allergenicity, and improved production of biofuels.

The present invention can additionally include methods for generating a transgenic plant using a host plant, said transgenic plant being more resistant to soybean cyst nematode (SCN) when compared to the host plant, said method comprising a step of introducing at least one transgene into said host plant, said at least one transgene being located within the chromosomal region. In various embodiments, the transgene comprises one or more heterologous nucleic acid sequences encoding one or more miRNA selected from SEQ ID NOs: 1-37. In yet other embodiments, the transgene comprises one or more heterologous nucleic acid sequences encoding one or more gene selected from SEQ ID NOs: 38-315. In still other embodiments, the transgene comprises one or more heterologous nucleic acid sequences encoding one or more miRNA selected from SEQ ID NOs: 1-37 and one or more heterologous nucleic acid sequences encoding one or more gene selected from SEQ ID NOs: 38-315. As used within this application, the phrase "heterologous nucleic acid" (and variations of this phrase) is used to indicate that the soybean plant into which one or more of SEQ ID NOs: 1-315 are introduced (by introgression or transformation for example) is not found within the genome of the soybean plant that was transformed or introgressed or that the soybean plant has been transformed or introgressed with one or more of SEQ ID NOs: 1-315 operably linked to a heterologous promoter (i.e., the promoter operably linked to any one or more of SEQ ID NOs: 1-315 is not the native promoter associated with the nucleic acid sequence of SEQ I NOs: 1-315). Such heterologous promoters are discussed below and include, but are not limited to, constitutive, inducible and tissue specific (preferred) promoters. A nucleic acid sequence that comprises a heterologous promoter operably linked to any one of SEQ ID NOs: 1-315 may be referred to as a "construct" within this application.

DETAILED DESCRIPTION OF THE EMBODIMENTS OF THE INVENTION

Figure 1:
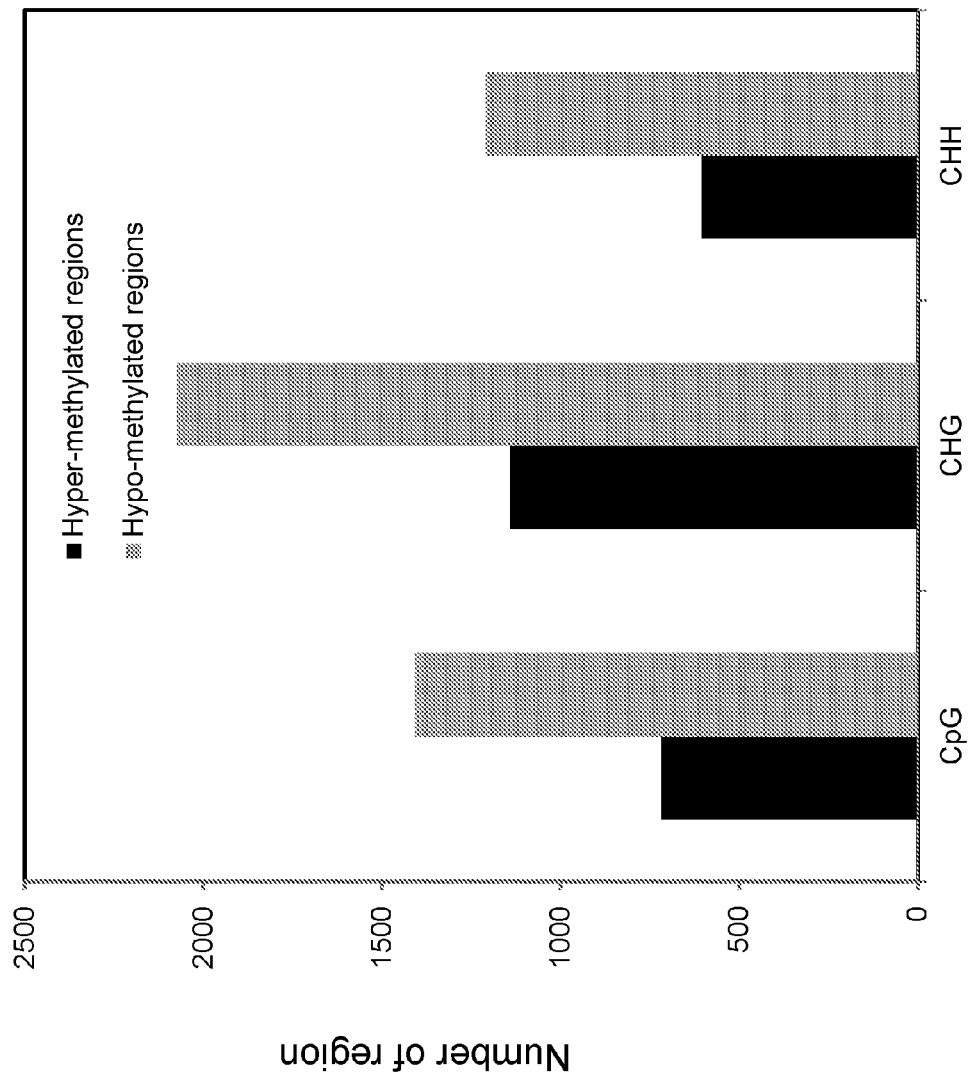
FIG. 1 is a number of differentially hyper- and hypo-methylated region in response to SCN infection.

The present invention relates to a novel and useful method for introgressing, in a reliable and predictable manner, SCN resistance into non-resistant soybean germplasm. The method involves the genetic-mapping of loci associated with SCN resistance. SCN race resistance can be determined in any acceptable manner; preferably in greenhouse conditions using a homogenous population of the particular SCN race.

Embodiments of the present inventions including studies on epigenetic modifications function in concert with genetic mechanisms to regulate transcriptional activity in normal cells and are often disregulated in infected cells. Epigenomics is the study of the pattern of chemical markers that serve as a regulatory layer on top of the DNA sequence. Depending on where they grow, the plants' epigenomic differences may allow them to rapidly adapt to their environments. Epigenomic modifications alter gene expression without changing the letters of the DNA alphabet (A-T-C-G), providing cells with an additional tool to fine-tune how genes control the cellular machinery.

By understanding epigenomic alterations in plants, the present invention can manipulate such alterations for various purposes, including biofuels and creating crops that can withstand stressful events such as drought. Such knowledge of epigenomic changes in crop plants could tell producers what to breed for and could have a huge impact on identifying plants that can survive certain conditions and adapt to environmental stresses. In the present invention such knowledge relates to SCN resistance.

Epigenetics can be defined as the biochemical modifications of DNA and associated proteins that regulate gene expression and chromosome structure and function, without changing DNA nucleotide sequences. DNA methylation, the most common epigenetic modifications, is the addition or removal of a methyl group ($CH_3$), mostly where cytosine bases occur repeatedly. In plants, DNA methylation occurs in symmetric (CG and CHG) and asymmetric (CHH) contexts where H refers to any nucleotide but G. The CG and CHG patterns are symmetric across the two DNA strands, which are believed to be important for the maintenance of methylation at these sites following DNA replication. DNA cytosine methylation, as the main epigenetic mark, controls gene expression networks and hence plays essential roles in different aspects of plant growth, development, and response to biotic stress (Zhang et al., 2010; He et al., 2011, Dowen et al. 2012). While DNA methylation has been initially reported to control various developmental processes in plants, recent studies revealed that this silencing pathway plays a key role in modulating plant defense responses during biotrophic interactions (Yu et al., 2013; Dowen et al. 2012; Luna et al., 2012). Recently, Dowen et al. (2012) provided a clear evidence of dynamic changes in DNA methylation in response to infection by the bacterial pathogen *Pseudomonas syringae* pv. tomato DC3000 (Pst). Using deep sequencing of bisulfite treated DNA, they found that differentially methylated regions (DMRs) are preferentially associated with genes involved in defense response, and that hypomethylation in DMRs is frequently accompanied by activation of the proximal genes, specifically those with defense response function. Similarly, another recent study indicated that DNA demethylation restricts the multiplication and vascular propagation of the Pst and, consequently some immune response genes, are repressed by DNA methylation (Yu et al., 2013). Chemical demethylation of the silenced resistance Xa21G gene in rice reestablished its resistance function against *Xanthomomonas oryzae* (Akimoto et al., 2007). Similarly, induced DNA hypomethylation at the NBS-LRR gene clusters by the tobacco mosaic virus was associated with increased genomic rearrangements at these genomic loci (Boyko et al., 2007). The expression difference between the resistant alleles of the *Medicago truncatula* REP1 gene, which confers resistance against the powdery mildew disease caused by the biotrophic fungus *Erysiphe pisi*, was found to be correlated with the methylation status at the promoter regions (Yang et al., 2013). In soybean, differential hypermethylation patterns at the genomic regions that contain multiple copies of SCN resistance gene Rhg1 have been recently identified (Cook et al., 2014). Collectively these results indicate that DNA methylation plays a crucial role in regulating the immune system in response to pathogen infection including cyst nematodes.

Epigenetic variation is when the phenotypic traits of an individual vary without altering the primary sequence of its DNA. This can occur through changes in the expression of particular genes via processes such as DNA methylation and chromatin remodelling, and by influencing the activity of RNA structures which regulate levels of gene expression.

Epigenetic changes in gene expression enable an individual to respond to changes in the environment and adjust the synthesis of proteins accordingly. It has become apparent that while many of the epigenetic modifications to the genome are reset during the process of meiosis, some epigenetic information can be transmitted between generations, so that the phenotypic traits of offspring are affected without altering the primary structure of the DNA. Thus offspring can inherit tolerance to a particular environmental condition before they have been exposed.

A nucleotide segment is referred to as "operably linked" when it is placed into a functional relationship with another DNA segment (for example, a promoter that is operably linked to any one of SEQ ID NOs: 1-315). However, enhancers need not be contiguous with the coding sequences whose transcription they control. Linking is accomplished by ligation at convenient restriction sites or at adapters or linkers inserted in lieu thereof. The expression cassette can include one or more enhancers in addition to the promoter. By "enhancer" is intended a cis-acting sequence that increases the utilization of a promoter. Such enhancers can be native to a gene or from a heterologous gene. Further, it is recognized that some promoters can contain one or more native, enhancers or enhancer-like elements. An example of one such enhancer is the 35S enhancer, which can be a single enhancer, or duplicated. See for example, McPherson et al, U.S. Pat. No. 5,322,938, which is hereby incorporated by reference in its entirety.

The promoter for driving expression of the transgenic polynucleotide of interest may be selected based on a number of criteria including, but not limited to, what the desired use is for the operably linked polynucleotide, what location in the plant is expression of the transgenic polynucleotide of interest desired, and at what level is expression of transgenic polynucleotide of interest desired or whether it needs to be controlled in another spatial or temporal manner. In one aspect, a promoter that directs expression to particular tissue may be desirable. When referring to a promoter that directs expression to a particular tissue is meant to include promoters referred to as tissue specific or tissue preferred. Included within the scope of the invention are promoters that express highly in the plant tissue, express more in the plant tissue than in other plant tissue, or express exclusively in the plant tissue. For example, "seed-specific" promoters may be employed to drive expression. Specific-seed promoters include those promoters active during seed development, promoters active during seed germination, and/or that are expressed only in the seed. Seed-specific promoters, such as annexin, P34, beta-phaseolin, alpha subunit of beta-conglycinin, oleosin, zein, napin promoters have been identified in many plant species such as maize, wheat, rice and barley. See U.S. Pat. Nos. 7,157,629, 7,129,089, and 7,109,392. Such seed-preferred promoters further include, but are not limited to, Cim1 (cytokinin-induced message); cZ19B1 (maize 19 kDa zein); and milps (myo-inositol-1-phosphate synthase); (see WO 00/11177, herein incorporated by reference). The 27 kDa gamma-zein promoter is a preferred endosperm-specific promoter. The maize globulin-1 and oleosin promoters are preferred embryo-specific promoters. For dicots, seed-specific promoters include, but are not limited to, bean beta phaseolin, napin, beta-conglycinin, soybean lectin, cruciferin, and the like. For monocots, seed-specific promoters include, but are not limited to, promoters of the 15 kDa beta-zein, 22 kDa alpha-zein, 27 kDa gamma-zein, waxy, shrunken 1, shrunken 2, globulin 1, an Ltp1, an Ltp2, and oleosin genes. See also WO 00/12733, where seed-preferred promoters from end1 and end2 genes are disclosed; herein incorporated by reference. Each of these aforementioned references are hereby incorporated by reference in their entireties, particularly as relates to the promoters disclosed within the references.

The promoters useful in the present invention can also include constitutive, inducible or tissue-specific (preferred) promoters that are operably linked to any one of SEQ ID NOs: 1-315 and are heterologous to the nucleic acid sequences to which they are operably linked. In other words, the promoters are not those found operably linked to any one of the nucleic acid sequence encoding the genes or miRNA of SEQ ID NOs: 1-315 in their native context within a soybean plant. Constitutive promoters, generally, are active in most or all tissues of a plant; inducible promoters, which generally are inactive or exhibit a low basal level of expression, and can be induced to a relatively high activity upon contact of cells with an appropriate inducing agent; tissue-specific (or tissue-preferred) promoters, which generally are expressed in only one or a few particular cell types (e.g., root cells); and developmental- or stage-specific promoters, which are active only during a defined period during the growth or development of a plant. Often promoters can be modified, if necessary, to vary the expression level. Certain embodiments comprise promoters exogenous to the species being manipulated (e.g. a soybean plant).

Non-limiting examples of root-specific promoters (a subset of tissue-specific promoters) include root preferred promoters, such as the maize NAS2 promoter, the maize Cyclo promoter (US 2006/0156439, published Jul. 13, 2006), the maize ROOTMET2 promoter (WO05063998, published Jul. 14, 2005), the CR1BIO promoter (WO06055487, published May 26, 2006), the CRWAQ81 (WO05035770, published Apr. 21, 2005) and the maize ZRP2.47 promoter (NCBI accession number: U38790; GI No. 1063664). Each of these aforementioned references are hereby incorporated by reference in their entireties, particularly as relates to the promoters disclosed within the references.

Exemplary constitutive promoters include the 35S cauliflower mosaic virus (CaMV) promoter (Odell et al. (1985) Nature 313:810-812), the maize ubiquitin promoter (Christensen et al. (1989) Plant Mol. Biol. 12:619-632 and Christensen et al. (1992) Plant Mol. Biol. 18:675-689); the core promoter of the Rsyn7 promoter and other constitutive promoters disclosed in WO 99/43838 and U.S. Pat. No. 6,072,050; rice actin (McElroy et al. (1990) Plant Cell 2:163-171); pEMU (Last et al. (1991) Theor. Appl. Genet. 81:581-588); MAS (Velten et al. (1984) EMBO J. 3:2723-2730); ALS promoter (U.S. Pat. No. 5,659,026); rice actin promoter (U.S. Pat. No. 5,641,876; WO 00/70067), maize histone promoter (Brignon et al., Plant Mol Bio 22(6):1007-1015 (1993); Rasco-Gaunt et al., Plant Cell Rep. 21(6):569-576 (2003)) and the like. Other constitutive promoters include, for example, those described in U.S. Pat. Nos. 5,608,144 and 6,177,611, and PCT publication WO 03/102198. Each of these aforementioned references are hereby incorporated by reference in their entireties, particularly as relates to the promoters disclosed within the references.

An inducible promoter/regulatory element is one that is capable of directly or indirectly activating transcription of one or more of SEQ ID NOs: 1-315 in response to an inducer. The inducer can be a chemical agent such as a protein, metabolite, growth regulator, herbicide or phenolic compound; or a physiological stress, such as that imposed directly by heat, cold, salt, or toxic elements, or indirectly through the action of a pathogen or disease agent such as a virus; or other biological or physical agent or environmental condition. A plant cell containing an inducible promoter/regulatory element may be exposed to an inducer by externally applying the inducer to the cell or plant such as by spraying, watering, heating or similar methods. An inducing agent useful for inducing expression from an inducible promoter is selected based on the particular inducible regulatory element. In response to exposure to an inducing agent, transcription from the inducible regulatory element generally is initiated de novo or is increased above a basal or constitutive level of expression.

Any inducible promoter/regulatory element can be used in the instant invention (See Ward et al., Plant Mol. Biol. 22: 361-366, 1993). Non-limiting examples of such promoters/regulatory elements include: a metallothionein regulatory element, a copper-inducible regulatory element, or a tetracycline-inducible regulatory element, the transcription from which can be effected in response to divalent metal ions, copper or tetracycline, respectively (Furst et al., Cell 55:705-717, 1988; Mett et al., Proc. Natl. Acad. Sci., USA 90:4567-4571, 1993; Gatz et al., Plant J. 2:397-404, 1992; Roder et al., Mol. Gen. Genet. 243:32-38, 1994). Inducible promoters/regulatory elements also include an ecdysone regulatory element or a glucocorticoid regulatory element, the transcription from which can be effected in response to ecdysone or other steroid (Christopherson et al., Proc. Natl. Acad. Sci., USA 89:6314-6318, 1992; Schena et al., Proc. Natl. Acad. Sci., USA 88:10421-10425, 1991; U.S. Pat. No. 6,504,082); a cold responsive regulatory element or a heat shock regulatory element, the transcription of which can be effected in response to exposure to cold or heat, respectively (Takahashi et al., Plant Physiol. 99:383-390, 1992); the promoter of the alcohol dehydrogenase gene (Gerlach et al., PNAS USA 79:2981-2985 (1982); Walker et al., PNAS 84(19):6624-6628 (1987)), inducible by anaerobic conditions; and the light-inducible promoter derived from the pea rbcS gene or pea psaDb gene (Yamamoto et al. (1997) Plant J. 12(2):255-265); a light-inducible regulatory element (Feinbaum et al., Mol. Gen. Genet. 226:449, 1991; Lam and Chua, Science 248:471, 1990; Matsuoka et al. (1993) Proc. Natl. Acad. Sci. USA 90(20):9586-9590; Orozco et al. (1993) Plant Mol. Bio. 23(6): 1129-1138), a plant hormone inducible regulatory element (Yamaguchi-Shinozaki et al., Plant Mol. Biol. 15:905, 1990; Kares et al., Plant Mol. Biol. 15:225, 1990), and the like. An inducible promoter/regulatory element also can be the promoter of the maize In2-1 or In2-2 gene, which responds to benzenesulfonamide herbicide safeners (Hershey et al., Mol. Gen. Gene. 227:229-237, 1991; Gatz et al., Mol. Gen. Genet. 243:32-38, 1994), and the Tet repressor of transposon Tn10 (Gatz et al., Mol. Gen. Genet. 227:229-237, 1991). Stress inducible promoters include salt/water stress-inducible promoters such as PSCS (Zang et al. (1997) Plant Sciences 129:81-89); cold-inducible promoters, such as, cor15a (Hajela et al. (1990) Plant Physiol. 93:1246-1252), cor15b (Wlihelm et al. (1993) Plant Mol Biol 23:1073-1077), wsc120 (Ouellet et al. (1998) FEBS Lett. 423-324-328), ci7 (Kirch et al. (1997) Plant Mol Biol. 33:897-909), ci21A (Schneider et al. (1997) Plant Physiol. 113:335-45); drought-inducible promoters, such as, Trg-31 (Chaudhary et al (1996) Plant Mol. Biol. 30:1247-57), rd29 (Kasuga et al. (1999) Nature Biotechnology 18:287-291); osmotic inducible promoters, such as Rab17 (Vilardell et al.

(1991) Plant Mol. Biol. 17:985-93) and osmotin (Raghothama et al. (1993) Plant Mol Biol 23:1117-28); and heat inducible promoters, such as heat shock proteins (Barros et al. (1992) Plant Mol. 19:665-75; Marrs et al. (1993) Dev. Genet. 14:27-41), smHSP (Waters et al. (1996) J. Experimental Botany 47:325-338), and the heat-shock inducible element from the parsley ubiquitin promoter (WO 03/102198). Other stress-inducible promoters include rip2 (U.S. Pat. No. 5,332,808 and U.S. Publication No. 2003/0217393) and rd29a (Yamaguchi-Shinozaki et al. (1993) Mol. Gen. Genetics 236:331-340). Certain promoters are inducible by wounding, including the *Agrobacterium* pmas promoter (Guevara-Garcia et al. (1993) Plant J. 4(3):495-505) and the *Agrobacterium* ORF13 promoter (Hansen et al., (1997) Mol. Gen. Genet. 254(3):337-343). Each of these aforementioned references are hereby incorporated by reference in their entireties, particularly as relates to the promoters disclosed within the references.

In this disclosure the term "isolated" nucleic acid molecule means a nucleic acid molecule that is separated from other nucleic acid molecules that are usually associated with the isolated nucleic acid molecule. Thus, an "isolated" nucleic acid molecule includes, without limitation, a nucleic acid molecule that is free of nucleotide sequences that naturally flank one or both ends of the nucleic acid in the genome of the organism from which the isolated nucleic acid is derived (e.g., a cDNA or genomic DNA fragment produced by PCR or restriction endonuclease digestion). Such an isolated nucleic acid molecule is generally introduced into a vector (e.g., a cloning vector or an expression vector) for convenience of manipulation or to generate a fusion nucleic acid molecule. In addition, an isolated nucleic acid molecule can include an engineered nucleic acid molecule such as a recombinant or a synthetic nucleic acid molecule. A nucleic acid molecule existing among hundreds to millions of other nucleic acid molecules within, for example, a nucleic acid library (e.g., a cDNA or genomic library) or a gel (e.g., agarose, or polyacrylamine) containing restriction-digested genomic DNA, is not an "isolated" nucleic acid.

The term "nucleic acid" or "polynucleotide" refers to deoxyribonucleic acids (DNA) or ribonucleic acids (RNA) and polymers thereof in either single- or double-stranded form. Unless specifically limited, the term encompasses nucleic acids containing known analogs of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, single nucleotide polymorphisms (SNPs), and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260: 2605-2608 (1985); and Rossolini et al., Mol. Cell. Probes 8:91-98 (1994)). The term nucleic acid is used interchangeably with gene, cDNA, and mRNA encoded by a gene.

The term "gene" means the segment of DNA involved in producing a polypeptide chain; it includes regions preceding and following the coding region (leader and trailer) involved in the transcription/translation of the gene product and the regulation of the transcription/translation, as well as intervening sequences (introns) between individual coding segments (exons).

In this application, the terms "polypeptide," "peptide," and "protein" are used interchangeably herein to refer to a polymer of amino acid residues. The terms apply to amino acid polymers in which one or more amino acid residue is an artificial chemical mimetic of a corresponding naturally occurring amino acid, as well as to naturally occurring amino acid polymers and non-naturally occurring amino acid polymers. As used herein, the terms encompass amino acid chains of any length, including full-length proteins (i.e., antigens), wherein the amino acid residues are linked by covalent peptide bonds.

The term "amino acid" refers to refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, .gamma.-carboxyglutamate, and O-phosphoserine. For the purposes of this application, amino acid analogs refers to compounds that have the same basic chemical structure as a naturally occurring amino acid, i.e., an a carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. For the purposes of this application, amino acid mimetics refers to chemical compounds that have a structure that is different from the general chemical structure of an amino acid, but that functions in a manner similar to a naturally occurring amino acid.

Amino acids may include those having non-naturally occurring D-chirality, as disclosed in WO01/12654, which may improve the stability (e.g., half life), bioavailability, and other characteristics of a polypeptide comprising one or more of such D-amino acids. In some cases, one or more, and potentially all of the amino acids of a therapeutic polypeptide have D-chirality.

Amino acids may be referred to herein by either the commonly known three letter symbols or by the one-letter symbols recommended by the IUPAC-IUB Biochemical Nomenclature Commission. Nucleotides, likewise, may be referred to by their commonly accepted single-letter codes.

As used in herein, the terms "identical" or percent "identity," in the context of describing two or more polynucleotide or amino acid sequences, refer to two or more sequences or subsequences that are the same or have a specified percentage of amino acid residues or nucleotides that are the same (for example, a variant protein used in the method of this invention has at least 80% sequence identity, preferably 85%, 90%, 91%, 92%, 93, 94%, 95%, 96%, 97%, 98%, 99%, or 100% identity, to a reference sequence), when compared and aligned for maximum correspondence over a comparison window, or designated region as measured using one of the following sequence comparison algorithms or by manual alignment and visual inspection. Such sequences are then said to be "substantially identical." With regard to polynucleotide sequences, this definition also refers to the complement of a test sequence. Preferably, the identity exists over a region that is at least about 50 amino acids or nucleotides in length, or more preferably over a region that is 75-100 amino acids or nucleotides in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. For sequence comparison of nucleic acids and proteins, the BLAST and BLAST 2.0 algorithms and the default parameters discussed below are used.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Current Protocols in Molecular Biology (Ausubel et al., eds. 1995 supplement)).

Examples of algorithms that are suitable for determining percent sequence identity and sequence similarity are the BLAST and BLAST 2.0 algorithms, which are described in Altschul et al., (1990) J. Mol. Biol. 215: 403-410 and Altschul et al. (1977) Nucleic Acids Res. 25: 3389-3402, respectively. Software for performing BLAST analyses is publicly available at the National Center for Biotechnology Information website, ncbi.nlm.nih.gov. The algorithm involves first identifying high scoring sequence pairs (HSPs) by identifying short words of length in the query sequence, which either match or satisfy some positive-valued threshold score T when aligned with a word of the same length in a database sequence. T is referred to as the neighborhood word score threshold (Altschul et al., supra). These initial neighborhood word hits acts as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a word size (W) of 28, an expectation (E) of 10, M=1, N=−2, and a comparison of both strands. For amino acid sequences, the BLASTP program uses as defaults a word size (W) of 3, an expectation (E) of 10, and the BLOSUM62 scoring matrix (see Henikoff and Henikoff, Proc. Natl. Acad. Sci. USA 89:10915 (1989)).

The BLAST algorithm also performs a statistical analysis of the similarity between two sequences (see, e.g., Karlin and Altschul, Proc. Nat'l. Acad. Sci. USA 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

An indication that two nucleic acid sequences or polypeptides are substantially identical is that the polypeptide encoded by the first nucleic acid is immunologically cross reactive with the antibodies raised against the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules or their complements hybridize to each other under stringent conditions, as described below. Yet another indication that two nucleic acid sequences are substantially identical is that the same primers can be used to amplify the sequence.

In this disclosure the terms "stringent hybridization conditions" and "high stringency" refer to conditions under which a probe will hybridize to its target subsequence, typically in a complex mixture of nucleic acids, but to no other sequences. Stringent conditions are sequence-dependent and will be different in different circumstances. Longer sequences hybridize specifically at higher temperatures. An extensive guide to the hybridization of nucleic acids is found in Tijssen, Techniques in Biochemistry and Molecular Biology—Hybridization with Nucleic Probes, "Overview of principles of hybridization and the strategy of nucleic acid assays" (1993) and will be readily understood by those skilled in the art. Generally, stringent conditions are selected to be about 5-10° C. lower than the thermal melting point ($T_m$) for the specific sequence at a defined ionic strength pH. The $T_m$ is the temperature (under defined ionic strength, pH, and nucleic concentration) at which 50% of the probes complementary to the target hybridize to the target sequence at equilibrium (as the target sequences are present in excess, at $T_m$, 50% of the probes are occupied at equilibrium). Stringent conditions may also be achieved with the addition of destabilizing agents such as formamide. For selective or specific hybridization, a positive signal is at least two times background, preferably 10 times background hybridization. Exemplary stringent hybridization conditions can be as following: 50% formamide, 5×SSC, and 1% SDS, incubating at 42° C., or, 5×SSC, 1% SDS, incubating at 65° C., with wash in 0.2×SSC, and 0.1% SDS at 65° C.

Nucleic acids that do not hybridize to each other under stringent conditions are still substantially identical if the polypeptides which they encode are substantially identical. This occurs, for example, when a copy of a nucleic acid is created using the maximum codon degeneracy permitted by the genetic code. In such cases, the nucleic acids typically hybridize under moderately stringent hybridization conditions. Exemplary "moderately stringent hybridization conditions" include a hybridization in a buffer of 40% formamide, 1 M NaCl, 1% SDS at 37° C., and a wash in 1×SSC at 45° C. A positive hybridization is at least twice background. Those of ordinary skill will readily recognize that alternative hybridization and wash conditions can be utilized to provide conditions of similar stringency. Additional guidelines for determining hybridization parameters are provided in numerous references, e.g., Current Protocols in Molecular Biology, ed. Ausubel, et al.

The soybean line selected for mapping can be subjected to DNA extraction. In embodiments of the present invention, the CTAB method (Murray and Thompson, Nucl. Acids Rev. 8:4321-4325, 1980; Keim et al., Soybean Genet. Newsl. 15:150-152, 1988) can be used. Nucleic acid probes can be used as markers in mapping the resistance loci, and appropriate probes can be selected based upon the mapping method to be used. The probes can be either RNA or DNA probes, and mapping can be performed using a number of methods recognized in the art, including, for example, AFLP, RFLP, RAPD, or microsatellite technology. Additionally, global gene expression profiling using microarrays has been extensively investigated during plant-nematode interactions.

In some embodiments of the present invention, DNA probes can be used for RFLP markers. Such probes can come from, for example, Pst I-cloned genomic libraries, and the cloned inserts used as probes may be amplified, for example by PCR, LCR, NASBA™, or other amplification methods recognized in the art. For example, the markers useful in a preferred embodiment of the invention include the following: pA85a, php02302a, php02340a, pK400a, pT155a, pBLT24a, pBLT65a, php05180a, pSAC3a, pA1116, php05266a, php022986, pA664a, pA63a, php02366a, php02361a, php05354a, php05219a, pK69a, pL50c, pK18a, pA567a, pA407a, pA4046, pA226a, pA715a, pK24a, pB157b, php02275a, php05278a, php05240c, pBLT49a, pK79a, and php03488a. FIG. 1 shows the linkage groups with which the foregoing probes are associated. The Pioneer Hi-Bred International, Inc. proprietary nucleic acid markers have been deposited with the ATCC and are available as follows: php05354 assigned ATCC 98495; php05219 assigned ATCC 98490; php02366 assigned ATCC 69934; php02340 assigned ATCC 69935; php02361 assigned ATCC 69936; php02301 assigned ATCC 69937; php05180 assigned ATCC 69938; php02275 assigned ATCC 69937; and php02302 assigned ATCC 69940. The other, non-proprietary probes are available from Linkage Genetics, Salt Lake City, Utah, and from Biogenetic Services, Brookings, S. Dak.

For RFLP mapping, restriction fragments can be generated using specific restriction enzymes, and the digestion, electrophoresis, Southern transfers and nucleic acid hybridizations are conducted according to art-recognized techniques. See, e.g., Keim et al., Theor. Appl. Genet. 77:786-792, 1989, the disclosure of which are hereby incorporated herein by reference.

In alternative embodiments of the present invention, RAPD technology can be utilized for genetic mapping. A DNA preparation can be amplified using art-recognized amplification techniques, and suitable nucleic acid markers are used. Alternatively, other genetic mapping technologies recognized in the art can be used in the practice of the present invention.

In a soybean breeding program, the method of the present invention envisions the use of marker-associated selection for one or more loci at any stage of population development in a two-parent population, multiple parent population, or a backcross population. Such populations are described in Fehr, W. R. 1987, Breeding Methods for Cultivar Development, in J. R. Wildox (ed.) Soybeans: Improvement, Production, and Uses, 2d Ed., the disclosures of which are hereby incorporated herein by reference.

Marker-assisted selection according to art-recognized methods can be made, for example, step-wise, whereby the different SCN resistance loci are selected in more than one generation; or, as an alternative example, simultaneously, whereby all three loci are selected in the same generation. Marker-assisted selection for SCN resistance can be done before, in conjunction with, or after testing and selection for other traits such as seed yield.

The DNA from target populations can also be obtained from any plant part, and each DNA sample may represent the genotype of single or multiple plant individuals (including seed).

Marker-assisted selection can also be used to confirm previous selection for SCN resistance or susceptibility made by challenging plants with soybean cyst nematodes in the field or greenhouse and scoring the resulting phenotypes.

The following examples offered by way of illustration and not by way of limitation.

Example 1

In order to profile the DNA methylation patterns at single nucleotide resolution during the susceptible interaction with SCN, six whole genome bisulfite-treated DNA libraries were constructed. In these experiments, soybean cultivar Williams 82 was inoculated with SCN (race 3) and root tissues were collected at 4 day post inoculation (dpi) from both infected and non-infected soybean roots, from three independent experiments. Three libraries from each infected and non-infected samples were generated and sequenced using the Illumina HiSeq platform. The sequencing data were grouped into six different files and a total number of 175 million 100 bp reads for SCN-infected samples and 182 million reads for non-infected control were obtained. After quality filtering a total of about 88 and 92 million reads for SCN-infected and non-infected samples respectively, were of high quality and uniquely mapped to soybean genome (Wm82.a2.v1) (Table 1).

TABLE 1

Summary of cytosine methylation in control and SCN-infected samples

|  | Control | SCN-Infected |
|---|---|---|
| Total number of high quality reads analyzed | 91,560,375 | 87,972,505 |
| Number of reads with unique hits | 59,900,029 | 59,875,941 |
| Mapping efficiency | 65.40% | 68.06% |
| Conversion % | 99.6% | 99.6% |
| Total number of C's analyzed | 1,874,012,046 | 1,792,959,026 |
| % methylated C's in CpG context | 81.00% | 78.60% |
| % methylated C's in CHG context | 59.30% | 56.40% |
| % methylated C's in CHH context | 5.50% | 5% |

These high quality sequence reads represent more than 10× genome coverage, a depth greater than which was previously reported in Arabidopsis and soybean (Dowen et al., 2012; Schmitz et al., 2013). Bisulfite conversion efficiency was higher than 99% as determined using the non-methylated lambda phage genome. The percentage of methylated cytosine (mC) in CpG, CHG and CHH contexts were very similar across all the biological replicates for SCN-infected and non-infected control. The SCN-infected samples had an average of 78.6%, 56.4% and 5.0% methylation overall mC in CpG, CHG and CHH contexts, respectively (Table 1). Similarly, the control samples had an average of 81%, 59.3% and 5.5% methylation overall mC in CpG, CHG and CHH contexts, respectively (Table 1). These data indicate that overall average methylation levels are very similar between the SCN-infected and control samples.

Example 2

The methylome of SCN-infected and control roots were compared to identify differentially methylated regions. Differentially hyper- and hypo-methylated regions (200 bp bin) in CpG, CHG and CHH contexts were identified using P-value <0.01 and percent methylation difference larger than 25%. 718 hyper-methylated regions and 1408 hypo-methylated regions were identified in the infected roots compared with the non-infected control in CpG (FIG. 1, Supplemental Table 1 and 2). 1142 hyper-methylated regions and 2074 hypo-methylated regions were identified in CHG (FIG. 1, Supplemental Table 3 and 4). 605 hyper-methylated regions and 1210 hypo-methylated regions were identified in CHH (FIG. 1, Supplemental Table 5 and 6). These results demonstrate that SCN induces hypo-methylation to much higher extent compared to hyper-methylation.

Example 3

Figure 2A:
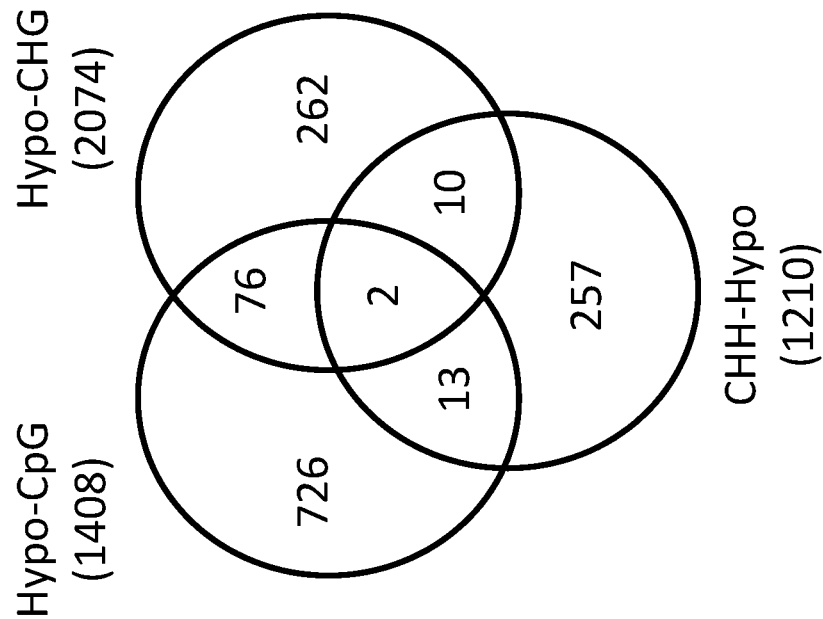
FIG. 2A is a venn diagram showing genes that are hyper-methylated in various contexts.
Figure 2B:
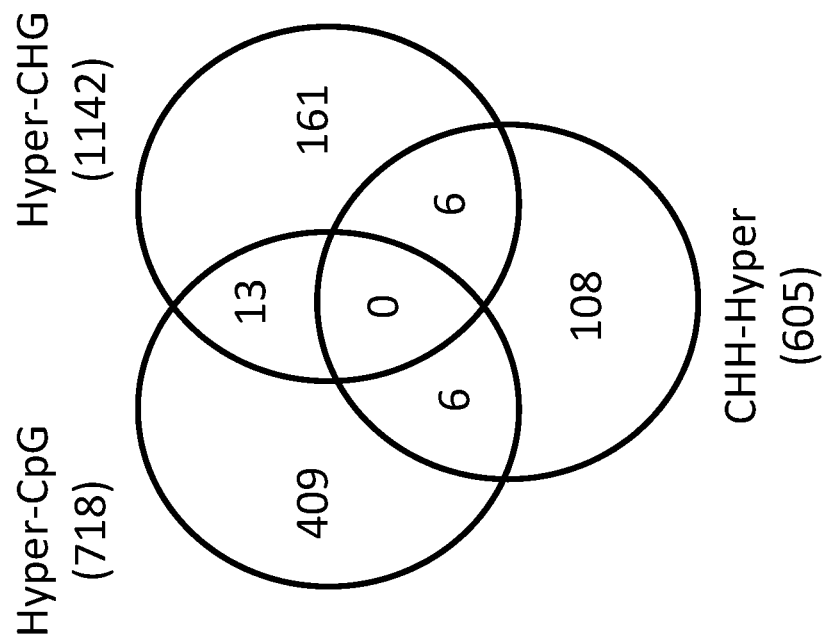
FIG. 2B is a venn diagram showing genes that are hypo-methylated in various contexts.

Gene overlapping was determined by comparing the hyper-methylated genes. Approximately 60% (429 genes), 16% (180 genes), and 20% (120 genes) of the hyper-methylated regions in CpG, CHG and CHH contexts, respectively, overlapped with protein-coding genes. Similarly, 58% (818 genes), 17% (350 genes), and 23% (282 genes) of the hypo-methylated regions in CpG, CHG and CHH contexts, respectively overlapped with protein-coding genes. As a result, a total number of 703 and 1346 unique genes were identified as hyper- and hypo-methylated, respectively (Supplemental Table 7 and 8). Methylation contexts occur in individual genes was next examined. Such examination found that 25 genes that were hyper-methylated in more than one context in which 6 genes were found to be hyper methylated in both CHH and CHH contexts, 6 genes in CHH and CpG and 13 genes in CpG and CHG contexts (FIG. 2A and Supplemental Table 7). Also, 101 genes that were hypo-methylated in more than one context were identified (FIG. 2B and Supplemental Table 8).

Figure 3B:
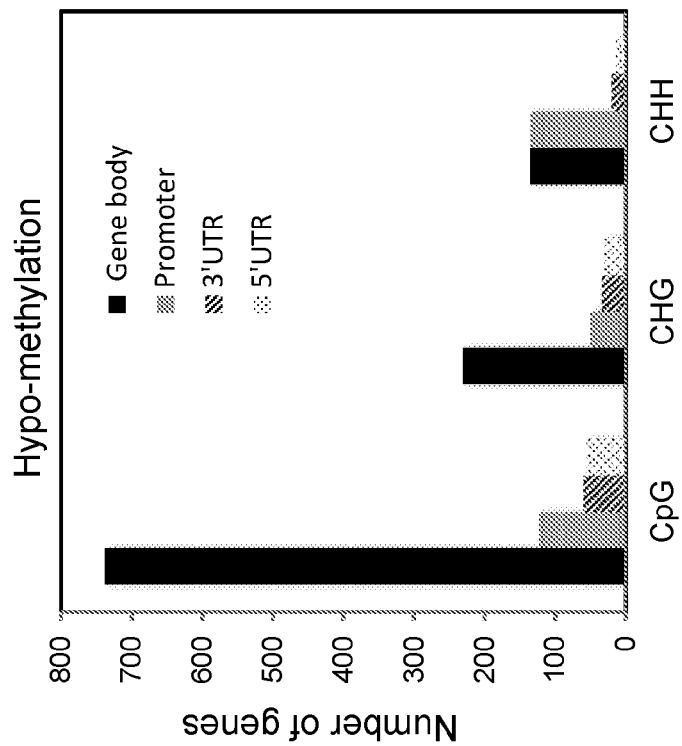
FIG. 3B is a bar chart illustrating the distribution of differentially Hypo-methylated regions in various features of protein-coding genes.
Figure 3A:
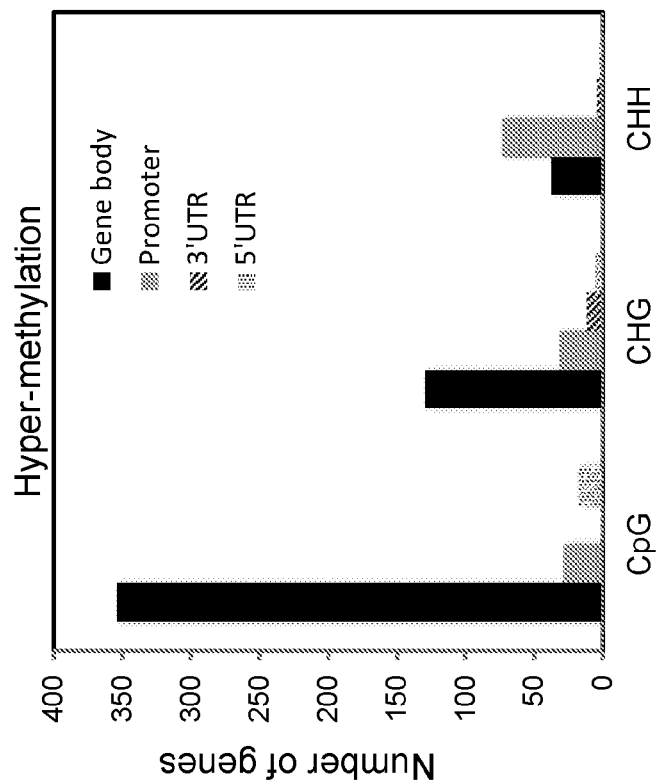
FIG. 3A is a bar chart illustrating the distribution of differentially hyper-methylated regions in various features of protein-coding genes.
Figure 4A:
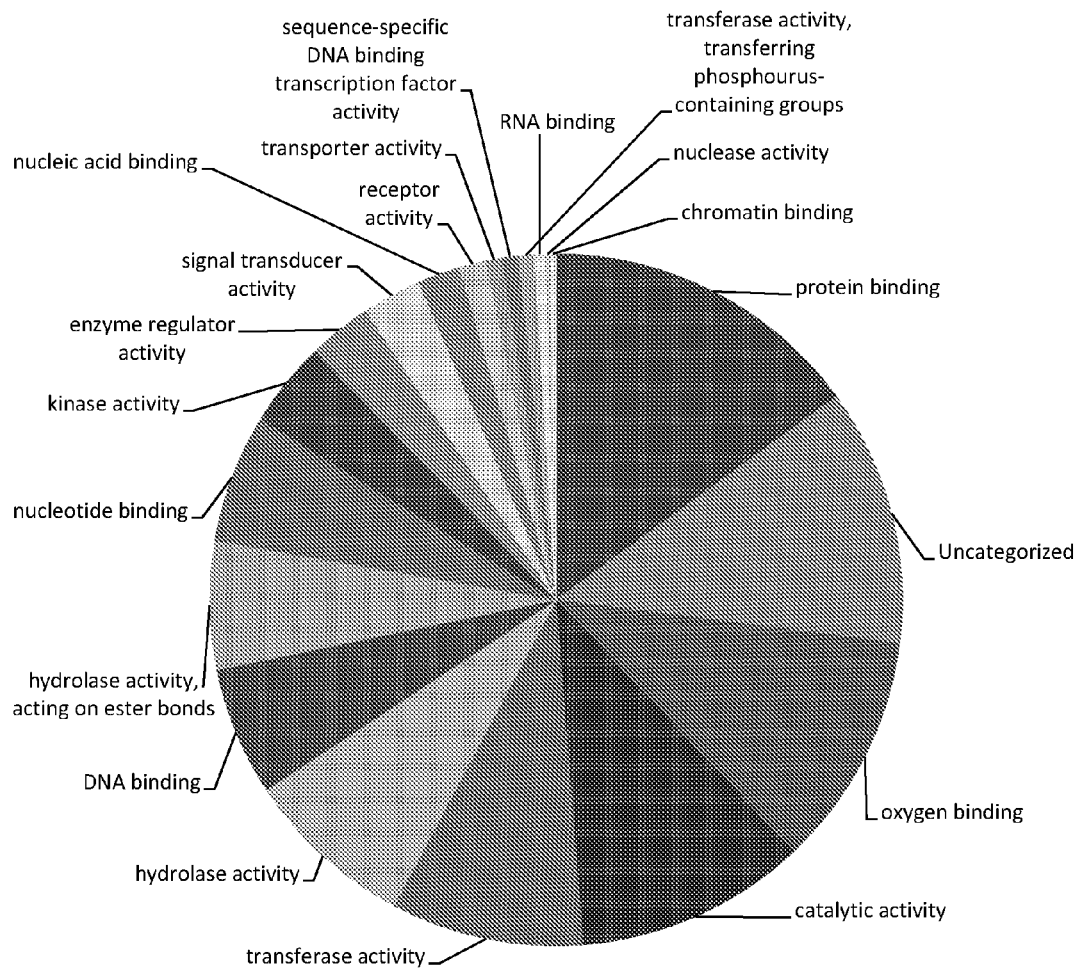
FIG. 4A illustrates the Gene Ontology categorization of the molecular functions of the differentially methylated genes.
Figure 4B:
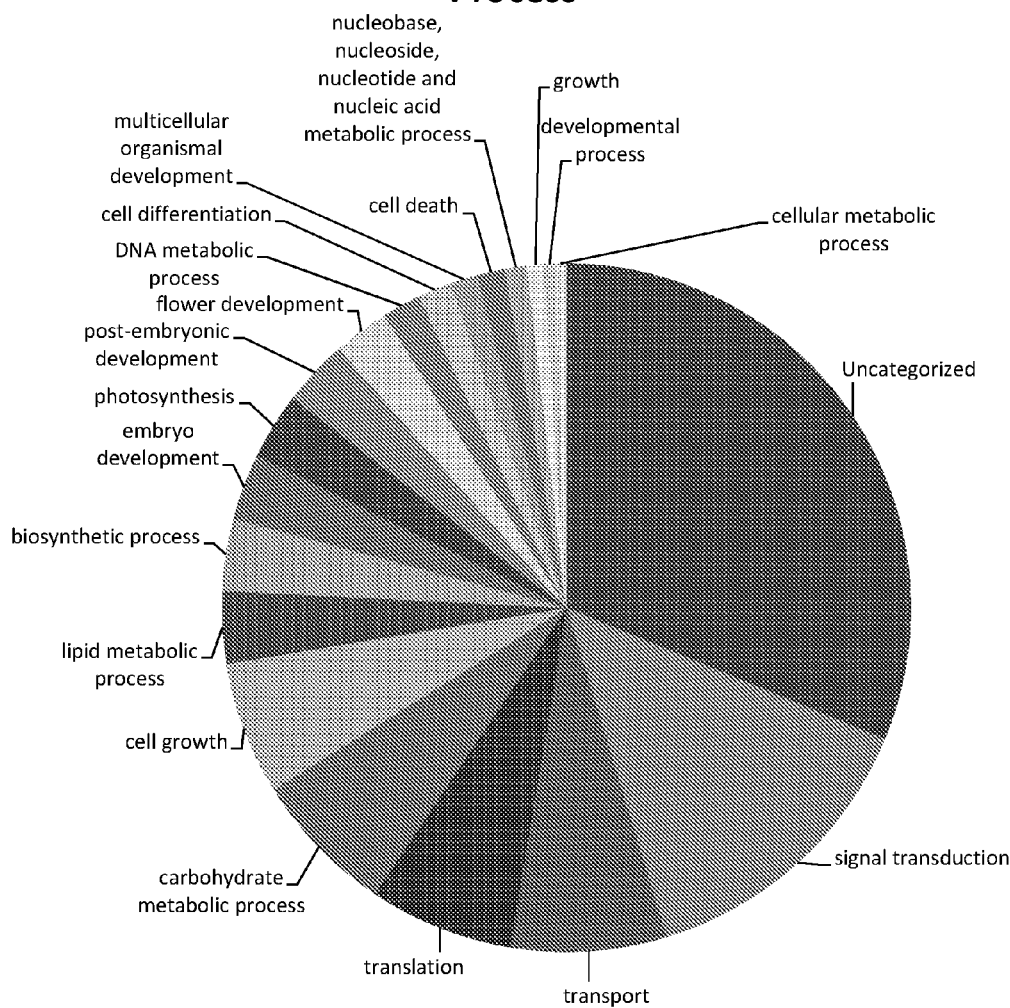
FIG. 4B illustrates the Gene Ontology categorization of the biological processes of the differentially methylated genes.

The hyper- and hypo-methylation in CpG and CHG contexts occur predominantly in the gene body and to much less extent in the flanking regions, including promoter, 5' and 3' untranslated regions (UTR) (FIGS. 3A and B). In contrast, CHH hyper-methylation was mainly located in the promoter regions, 1000 bp upstream of the transcription start site (TSS). A set of 45 genes showed both hyper- and hypo-methylation in various genic and promoter regions The DMR-associated genes into different groups by molecular function and associated biological processes using the Gene Ontology (GO) categorization from SoyBase (see Worldwide Website: soybase.org). Molecular function groups were found to correspond to binding activity, catalytic activity, transferase activity and hydrolase activity (FIG. 4A). When these genes were grouped by associated biological processes a significant portion of genes was found to be associated with signal transduction, carbohydrate metabolic process, transport, cell growth, and translation (FIG. 4B). GO term enrichment analysis revealed that genes associated with gene silencing, organ morphogenesis and actin nucleation are overrepresented.

Example 4

Figure 5A:
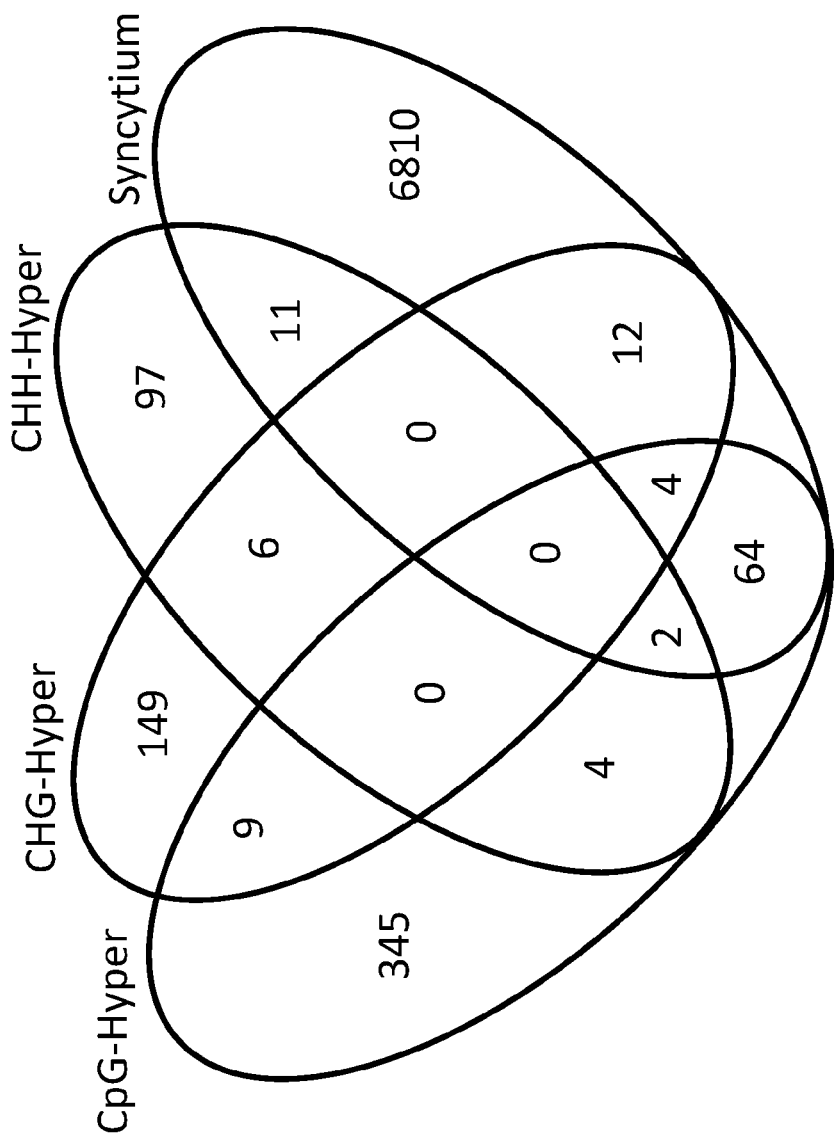
FIGS. 5A-5D depict the functional classification of differentially methylated genes overlapping with syncytium differentially expressed genes. A and B: Venn diagrams showing overlaps between differentially hyper-methylated (A) and Hypo-methylated (B) genes with syncytium differentially expressed genes. C and D; Gene Ontology categorization of the molecular functions (C) or the biological processes (D) of the differentially methylated genes overlapping with syncytium differentially expressed genes.
Figure 5B:
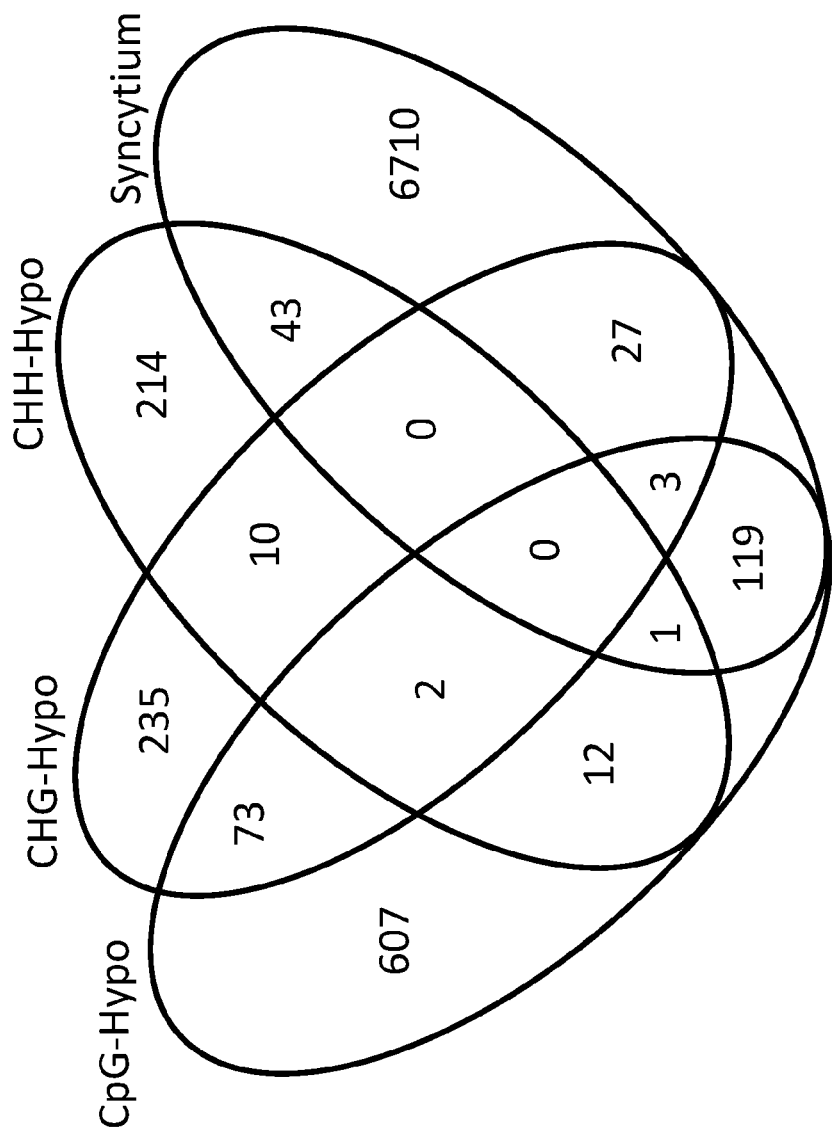

It was further determined that the overlap with the syncytium differentially expressed genes. The differentially hyper- and hypo-methylated genes identified were compared with a reference list of genes that changes the expression in the syncytium induced by SCN (6962 genes). 70, 16 and 13 genes of differentially hyper-methylated genes in CpG, CHG and CHH contexts, were determined to respectively overlap with syncytial differentially expressed genes (FIG. 5A). Similarly, 123, 30 and 44 genes of differentially hypo-methylated genes in CpG, CHG and CHH contexts, respectively were found to overlap with syncytial differentially expressed genes (FIG. 5B). After eliminating duplicated genes that are differentially methylated in more than one context, 93 genes were identified of the differentially hyper-methylated genes and 193 of the differentially hypo-methylated genes as overlapping with the 6962 syncytium-regulated genes (Supplemental Table 9 and 10). A set of 8 genes were found to be both hyper- and hypomethylated in different genic regions.

Figure 5C:
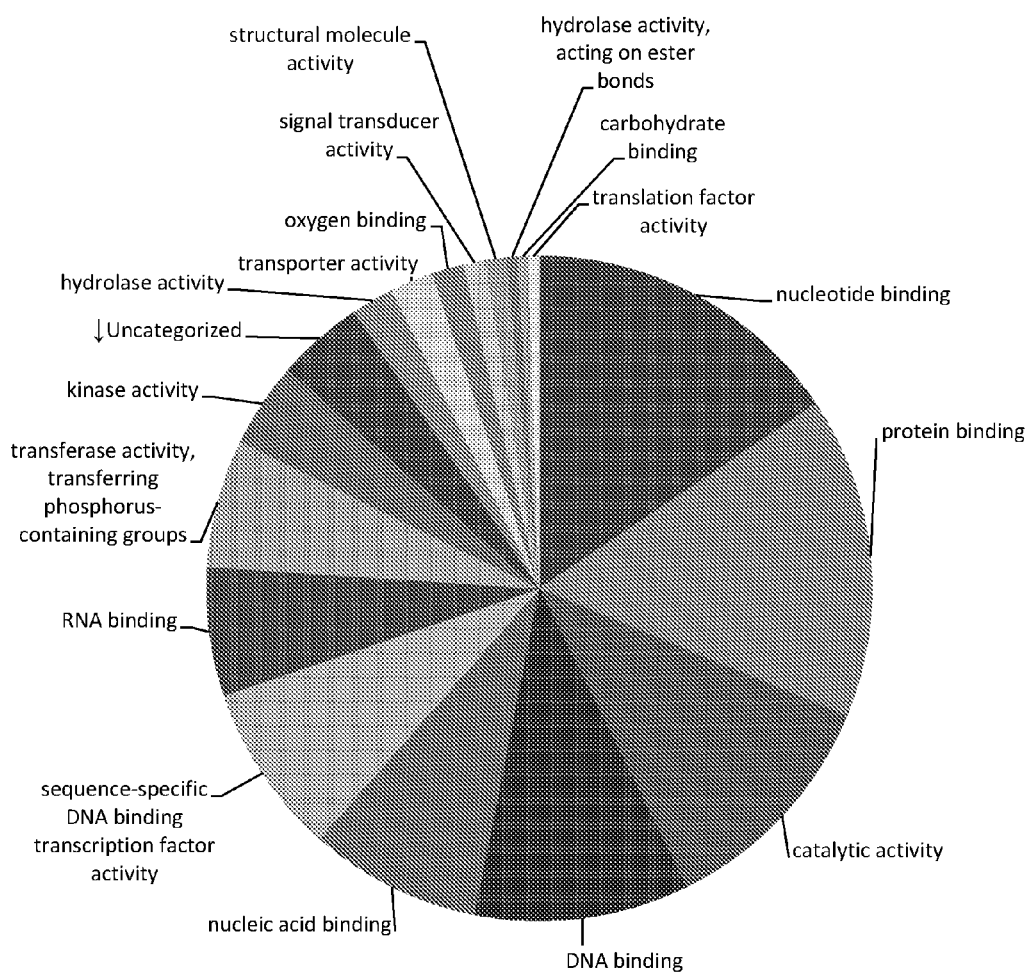
Figure 5D:
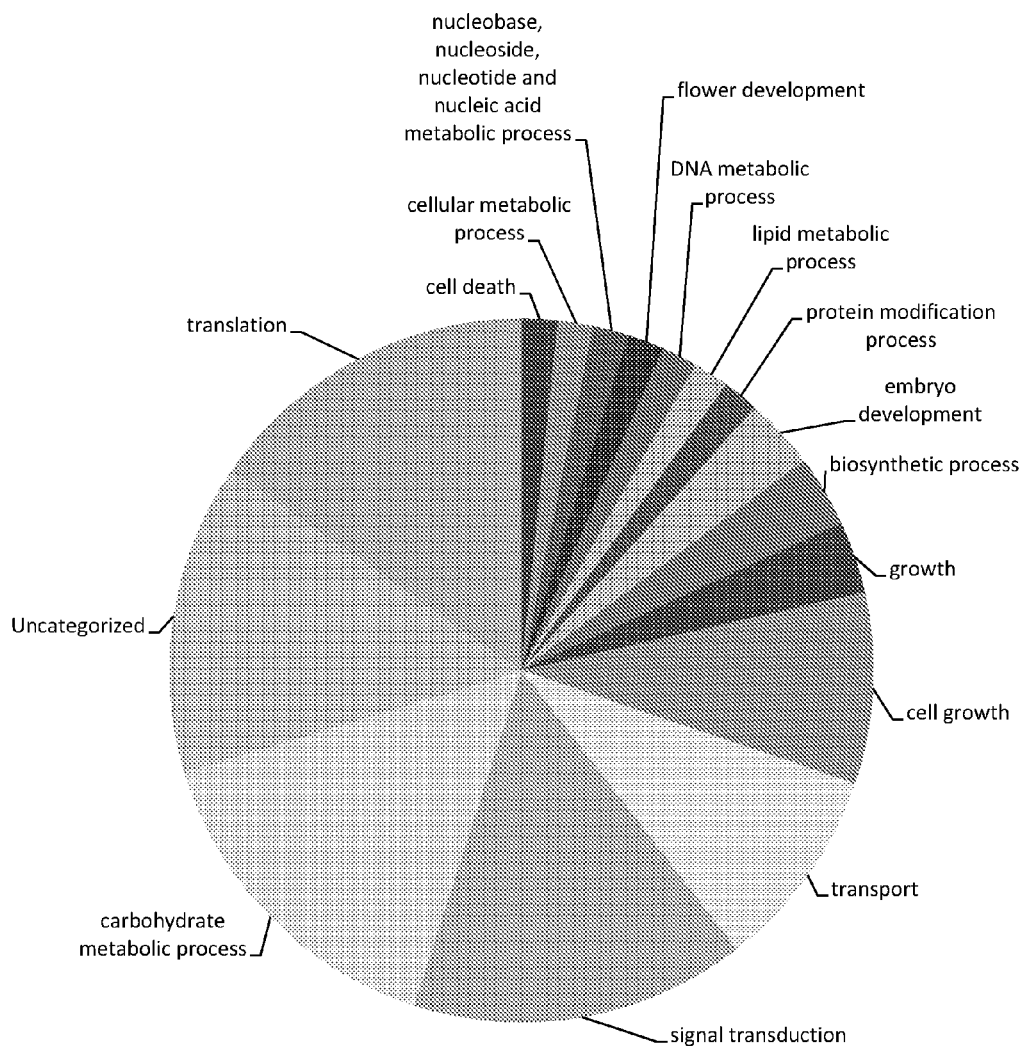

These 278 genes represent only 4% of the total number of syncytium-regulated genes. When these genes were classified by molecular function and associated biological processes using GO categorization, the binding activity and catalytic activity were determined to be the most abundant molecular functions of these genes (FIG. 5C), whereas translation, signal transduction, carbohydrate metabolic process and transport are the most abundant associated biological processes (FIG. 5D).

Example 5

Figure 6A:
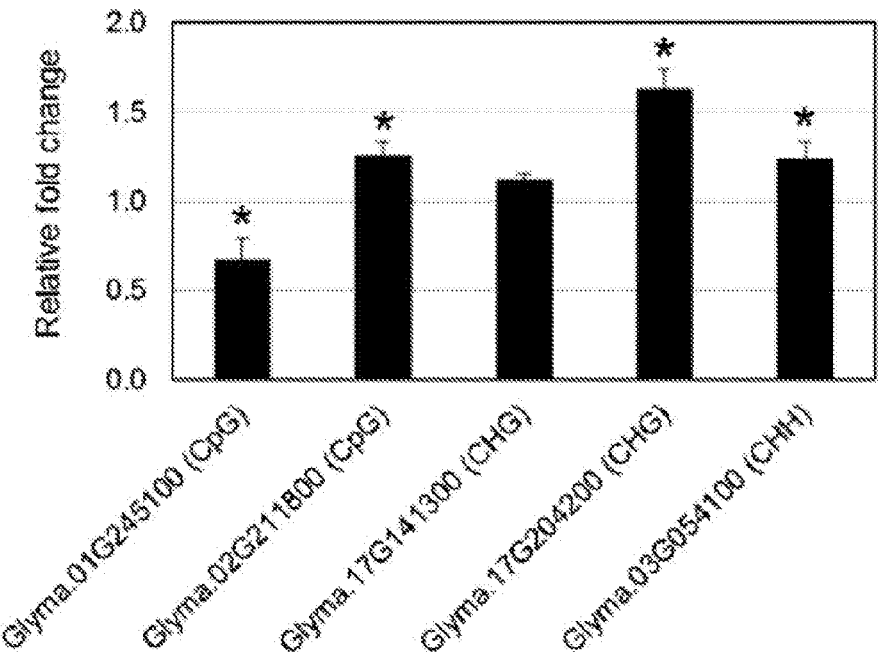
FIGS. 6A-6D illustrate quantitative real-time RT-PCR (qPCR) assays showing the impact of differential hyper- and hypo-methylation on gene expression levels.
Figure 6B:
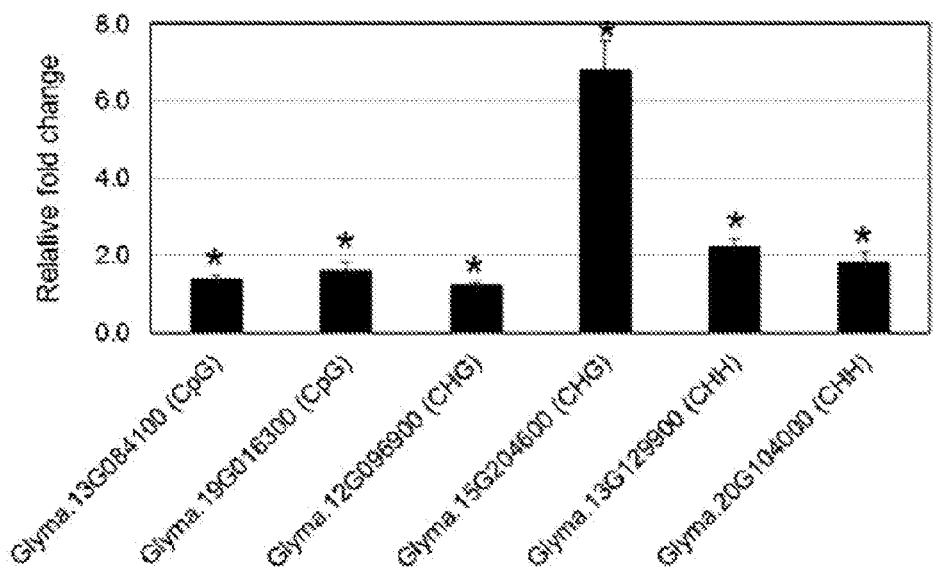
Figure 6C:
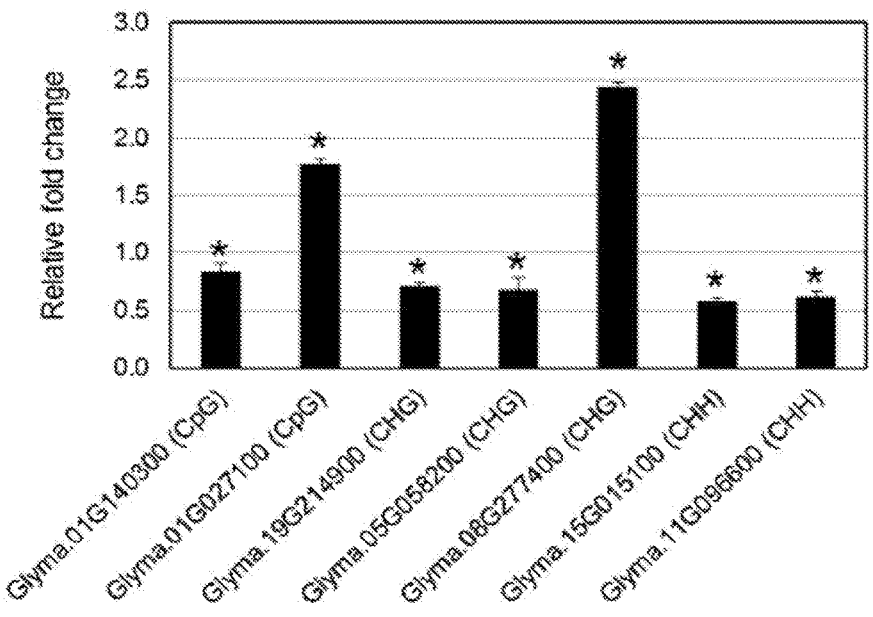
Figure 6D:
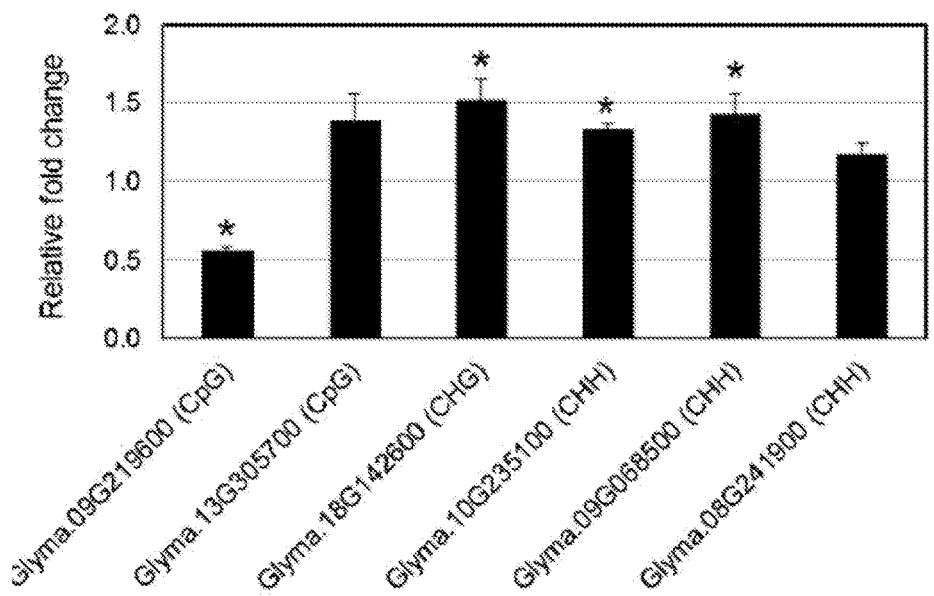

Next the impact of DNA methylation in the gene body and promoter regions on the gene expression levels was tested. RNA was isolated from the same SCN-infected and control samples and used in quantitative real-time RT-PCR (qPCR) assays. An association between gene body hyper-methylation in various contexts and both increased and decreased gene expression levels (FIG. 6A), whereas hypo-methylation gene body was found to be correlated with increased levels of gene expression (FIG. 6B). The study also demonstrated that increased CpG, CHG and CHH methylation in the promoter regions was negatively correlated with gene expression levels, whereas demethylation was positively correlated with gene expression levels (FIGS. 6C and D). This illustrates that the differential methylation in gene bodies and promoters contributes to gene expression regulation.

Example 6

An examination also determined whether differential cytosine methylation occurs in miRNA genes in response to SCN infection. Three miRNA genes (miR169s, miR394 and miR5036) were identified as hypermethylated at the promoter region (1 KB upstream of TSS site) in CHH or CpG contexts (Table 2).

TABLE 2

List of 37 miRNA genes that are differentially methylated in response to SCN infection. The sequences of the miRNA can be found in the sequence listing or at mirbase.org.

| Differentially Methylated Region | Context | Gend ID | Description | Gene feature |
|---|---|---|---|---|
| Chr01.2409001-2410000 | Hypo_CpG | MI0016507 | gma-miR4367 | promoter |
| Chr01.42333001-42334000 | Hypo_CHG | MI0017845 | gma-miR390c | promoter |
| Chr01.49102001-49103000 | Hypo_CHH, CHG | MI0017838 | gma-miR171d | promoter |
| Chr01.7196001-7197000 | Hypo_CHG | MI0001787 | gma-miR398a | promoter |
| Chr02.14637001-14638000 | Hypo_CpG | MI0001778 | gma-miR167b | promoter |
| Chr03.2852001-2853000 | Hypo_CpG | MI0031032 | gma-miR9746e | promoter |
| Chr03.2871001-2872000 | Hyper_CHG | MI0031033 | gma-miR9746f | promoter |
| Chr04.12841001-12842000 | Hypo_CHG | MI0007237 | gma-miR1522 | promoter |
| Chr04.46346001-46347000 | Hypo_CpG | MI0018674 | gma-miR319i | promoter |
| Chr06.11435001-11436000 | Hypo_CHG, CPG | MI0031039 | gma-miR319o | promoter |
| Chr06.11979001-11980000 | hyper_CpG | MI0016470 | gma-miR4341 | promoter |
| Chr06.1502001-1503000 | hyper_CpG, CHG | MI0021713 | gma-miR394g | miRNA primary transcript & promoter |
| Chr06.47265001-47266000 | hyper_CpG | MI0019728 | gma-miR5778 | promoter |
| Chr07.11671001-11672000 | Hypo_CpG | MI0016511 | gma-miR4369 | promoter |
| Chr07.11672001-11673000 | hyper_CpG | MI0016511 | gma-miR4369 | promoter |
| Chr07.1365001-1366000 | hyper_CpG | MI0016539 | gma-miR4386 | promoter |
| Chr07.1503001-1504000 | Hypo_CHH | MI0016526 | gma-miR4379 | promoter |
| Chr07.19892001-19893000 | Hypo_CHG | MI0010576 | gma-miR2107 | promoter |
| Chr08.1770001-1771000 | hyper_CpG | MI0017909 | gma-miR5036 | promoter |
| Chr08.4639001-4640000 | Hypo_CpG | MI0018645 | gma-miR397a | miRNA primary transcript & promoter |
| Chr08.46830001-46831000 | Hypo_CpG | MI0019267 | gma-miR5037d | promoter |
| Chr09.28529001-28530000 | Hypo_CHG | MI0017855 | gma-miR1508c | promoter |
| Chr10.31594001-31595000 | Hypo_CHG | MI0018668 | gma-miR172g | promoter |
| Chr11.29820001-29821000 | hyper_CpG, CHG | MI0018622 | gma-miR5369 | promoter |
| Chr11.33759001-33760000 | hyper_CpG, CHG | MI0016512 | gma-miR4370 | promoter |
| Chr11.9033001-9034000 | Hypo_CpG | MI0019740 | gma-miR828a | miRNA primary transcript & promoter |
| Chr13.37640001-37641000 | Hyper_CHG | MI0031006 | gma-miR4348b | promoter |
| Chr16.29727001-29728000 | Hypo_CpG | MI0031009 | gma-miR9729 | promoter |
| Chr17.1497001-1498000 | hyper_CHH | MI0007227 | gma-miR1514b | miRNA primary transcript & promoter |
| Chr17.6626001-6627000 | hyper_CpG | MI0016518 | gma-miR4373 | promoter |
| Chr18.3402001-3403000 | Hypo_CHG | MI0016552 | gma-miR4396 | miRNA primary transcript & promoter |
| Chr18.35312001-35313000 | hyper_CpG | MI0010576 | gma-miR2107 | promoter |
| Chr19.1919001-1920000 | Hypo_CpG | MI0019714 | gma-miR5225 | promoter |
| Chr19.47164001-47165000 | hyper_CpG, CHG | MI0017848 | gma-miR408d | promoter |
| Chr20.35349001-35350000 | Hypo_CpG | MI0017849 | gma-miR2118a | miRNA primary transcript & promoter |
| Chr20.37903001-37904000 | hyper_CpG | MI0017926 | gma-miR167i | promoter |
| Chr20.40357001-40358000 | hyper_CpG | MI0007250 | gma-miR1531 | miRNA primary transcript &promoter |

TABLE 2A

Differentially methylated region overlapping with miRNA genes

| Differentially methylated region | Context | Gene ID | Description | Gene Feature |
|---|---|---|---|---|
| Chr04.1509401-1509600 | Hyper CHH | MI0017846 | gma-miR394c | Promoter |
| Chr08.1770401-1770600 | Hyper CpG | MI0017909 | gma-gma-miR5036 | Promoter |
| Chr17.4864201-4864400 | Hyper CHH | MI0019763 | gma-miR169S | Promoter, Primary transcript |
| Chr01.2409601-2409800 | Hypo CpG | MI0016507 | gma-miR4367 | Promoter |
| Chr03.5293001-5293200 | Hypo CHH | MI0017827 | gma-miR164c | Promoter |

In addition, miR164 and miR4367 were identified as demethylated at the promoter region in CHH and CpG contexts, respectively (Table 2).

While the foregoing instrumentalities have been described in some detail for purposes of clarity and understanding, it will be clear to one skilled in the art from a reading of this disclosure that various changes in form and detail can be made without departing from the true scope of the invention. For example, all the techniques and apparatus described above may be used in various combinations. All publications, patents, patent applications, or other documents cited in this application are incorporated by reference in their entirety for all purposes to the same extent as if each individual publication, patent, patent application, or other document were individually indicated to be incorporated by reference for all purposes.

Lengthy table referenced here

US10457956-20191029-T00001

Please refer to the end of the specification for access instructions.

Lengthy table referenced here

US10457956-20191029-T00002

Please refer to the end of the specification for access instructions.

Lengthy table referenced here

US10457956-20191029-T00003

Please refer to the end of the specification for access instructions.

Lengthy table referenced here

US10457956-20191029-T00004

Please refer to the end of the specification for access instructions.

Lengthy table referenced here

US10457956-20191029-T00005

Please refer to the end of the specification for access instructions.

Lengthy table referenced here

US10457956-20191029-T00006

Please refer to the end of the specification for access instructions.

Lengthy table referenced here

US10457956-20191029-T00007

Please refer to the end of the specification for access instructions.

Lengthy table referenced here

US10457956-20191029-T00008

Please refer to the end of the specification for access instructions.

Lengthy table referenced here

US10457956-20191029-T00009

Please refer to the end of the specification for access instructions.

Lengthy table referenced here

US10457956-20191029-T00010

Please refer to the end of the specification for access instructions.

Sequences of the genes identified by the Glyma IDs provided in Supplemental Tables 7-10 can be found in the soybase.org database and the sequences associated with the Glyma IDs within the Soybase.org database are hereby incorporated by reference in their entireties.

LENGTHY TABLES

The patent contains a lengthy table section. A copy of the table is available in electronic form from the USPTO web site (http://seqdata.uspto.gov/?pageRequest=docDetail&DocID=US10457956B2). An electronic copy of the table will also be available from the USPTO upon request and payment of the fee set forth in 37 CFR 1.19(b)(3).

SEQUENCE LISTING (315 sequences)

SEQ ID NO: 1 - RNA, 225 nt, Glycine max
  misc_feature (1)..(225): gma-miR4367
caauuuccaucaaaacaauacuccccuaaaaccuagaacaaaauaugauauaauugauuuacuucacuaggguucaggacaauauucaaucaugcuuggcucacugcaggacaaugcuagucauucucucacaugauugaauauuauccugaacccuagcgaaguaaaucaauuguaucauaucuuguucuagguuuuaggaaagcauugucuugauggaaauug

SEQ ID NO: 2 - RNA, 90 nt, Glycine max
  misc_feature (1)..(90): gma-miR390c
uguaaagcucaggagggauagcgccauggaugaucucuucuccacucuugaucuucucuugcgcuauccauccugaguuucauggcuucu

SEQ ID NO: 3 - RNA, 110 nt, Glycine max
  misc_feature (1)..(110): gma-miR171d
agccauugugcuauuggcucgguucacucagacacaaaacaaccauaucacaacauuugugguuuucguuuuugaaucuuugauugagucgugucaauaucucacugcua

SEQ ID NO: 4 - RNA, 116 nt, Glycine max
  misc_feature (1)..(116): gma-miR398a
cucggaggagugaaucugagaacacaaggcugguuugcacugcuauaucaucuauugguauaaggugaauuuacuuuguguucucaggucaccccuuugagccaaccuguugacau

SEQ ID NO: 5 - RNA, 121 nt, Glycine max
  misc_feature (1)..(121): gma-miR167b
aagggucacaaaggaaaaagugaagcugccagcaugaucuagcuuugguuagugggagcgagagagugcuaacccucacuaggucaugcugugcuagccucacuccuuccuauuuggagac

SEQ ID NO: 6 - RNA, 110 nt, Glycine max
  misc_feature (1)..(110): gma-miR9746e
acgguuauccaauugagauucaaguacuuuuuuauguggcuuuaagguguguuugaauggaauaccuuaaauccaugaagaaaaguguuugaaucucaauuagauaacca

SEQ ID NO: 7 - RNA, 110 nt, Glycine max
  misc_feature (1)..(110): gma-miR9746f
acgguuauccaauugagauucaagcacuuuucuauguaguuuuaagguguguuugaauggaacaccuuaaauccaugaagaaaaguguuugaaucucaauuagauaacca

SEQ ID NO: 8 - RNA, 188 nt, Glycine max
  misc_feature (1)..(188): gma-miR1522
uacagacaaauuuauugcuuaaaaugaaauuaaccaacuuucuuaaaaugcauaaaauaguuaauguuuuauaauuaguaugauuacccguguaauguaacauugugauuuuucuaauucaugauaaagugauugaaaauaauuauaagaguuaguuuaauuuaauuuuaaagaauaauuaauaaaua

SEQ ID NO: 9 - RNA, 194 nt, Glycine max
  misc_feature (1)..(194): gma-miR319i
aagagagugaaggagcuuccuucagcccacgcauggguucgggggauugaaggguugcugaagcaucugcugacucauucauacacacagaauagugauucaaauugcuaagguaauugugugaaugaagcaggagauauuuugcaucccucuuucuuugugcuuggacugaaggggagcuccuucuuucuguu

SEQ ID NO: 10 - RNA, 195 nt, Glycine max
  misc_feature (1)..(195): gma-miR319o
gagagugaaggagcuuccuucagcccaugcauggauucaagggauuaaaggguugcuggaguaucugcugacucauucauacacacacaguacguagugcuuucaaauugcuaguguaauugugugaaugaagcaggugauauuuugcaccccucuuuucucugugcuuggacugaaggggagcuccuucuuucu

SEQ ID NO: 11 - RNA, 116 nt, Glycine max
  misc_feature (1)..(116): gma-miR4341
acccucaugugaaacuuucaacauauuucucuauuuagguguaaccacaccuucccucacacucaauagauucuuauauagauaaagagauguguugaaaguuuaacaugacgggu

SEQ ID NO: 12 - RNA, 80 nt, Glycine max
  misc_feature (1)..(80): gma-miR394g
acagaguuucuuggcauucuguccaccuccacuucuuggcccuaucuacguacucggagguggauauacugccaauagag

SEQ ID NO: 13 - RNA, 123 nt, Glycine max
  misc_feature (1)..(123): gma-miR5778
gcaucaacuucgacgaacucuucgucggcaucgacauccacggagaugucuugccggacuuggagauguucggcgaguucuccguggaugucagcaccggcgaggaaucgucggagaugaacu

SEQ ID NO: 14 - RNA, 79 nt, Glycine max
  misc_feature (1)..(79): gma-miR4369
uuuuccucuuucggaucaacuugauccggaagagacuuacggaucaacuuacggaucaagcugauccggaaguggaaaa

SEQ ID NO: 15 - RNA, 79 nt, Glycine max; identical to SEQ ID NO: 14
  misc_feature (1)..(79): gma-miR4369

SEQ ID NO: 16 - RNA, 55 nt, Glycine max
  misc_feature (1)..(55): gma-miR4386
ucucgaagguucuggagaggacugcauuugcgauccucucuagaaccuuccgaga

SEQ ID NO: 17 - RNA, 84 nt, Glycine max
  misc_feature (1)..(84): gma-miR4379
uuagaguguauacugugagaggccuaacucaaccccaaaagcuaacucaagggaugaggguugccccuuauuuauauauucuaa

SEQ ID NO: 18 - RNA, 54 nt, Glycine max
  misc_feature (1)..(54): gma-miR2107
auccaaaccuccguagccuguaucaaacgauccacuccuacucagguucacauc

SEQ ID NO: 19 - RNA, 151 nt, Glycine max
  misc_feature (1)..(151): gma-miR5036
agggguugauuguucacucucccucaagggcuucucgcuuuaacauccaagaacaagacuagaggcccuuggggaggaguaaauaagcuguuccuuauauauauauauauauauaacacaaagaaguucaucuuguuucucaccuucauaa

SEQ ID NO: 20 - RNA, 108 nt, Glycine max
  misc_feature (1)..(108): gma-miR397a
agagaaacaucauugagugcagcguugaugaaguuucacucucaucucagguagaugcuuaauuuauaguguuauugucaucgacacugcacucaaucauguuuuucu

SEQ ID NO: 21 - RNA, 106 nt, Glycine max
  misc_feature (1)..(106): gma-miR5037d
uagucuuuuggugacccucaaaggcuuccacuacuucauuuuacgaucgauucaauaucgagaaacaugaaggugcgggagccuaugaagguuaacuaaaggaacu

SEQ ID NO: 22 - RNA, 90 nt, Glycine max
  misc_feature (1)..(90): gma-miR1508c
cuacucaacugcuauuuuccuuuuugaaccuuguuaccuugagcaucuugaucaauuguuuagaaagggaaauagcaguugaguagugcu

SEQ ID NO: 23 - RNA, 114 nt, Glycine max
  misc_feature (1)..(114): gma-miR172g
gcaggugcagcaccaucaagauucacaugcaauuuacacccuauaagagauuuuugacaaaauuucuuuccuaggagaguuuugacuugagaaucuugaugaugcugcaucagc

SEQ ID NO: 24 - RNA, 115 nt, Glycine max
  misc_feature (1)..(115): gma-miR5369
agcugaaucuuuuuuuucugagagcaugaucccaugcugguuggcuaucucaaagaauugaugcaacaauuuuuuaugagaggcaauaucuuuugagaaaaggaggaugucaucu

SEQ ID NO: 25 - RNA, 66 nt, Glycine max
  misc_feature (1)..(66): gma-miR4370
cggaguagacucguccgauuuugcguagacuuggacaaguuuggguagacucgcgagucugcuccg

SEQ ID NO: 26 - RNA, 113 nt, Glycine max
  misc_feature (1)..(113): gma-miR828a
uuguaauguuucuugcucaaaugaguauuccaaccacagucacauuuggcaugaauauugugugccacuguccucaaaggaugagaugcucauuugaccaagcaauguuaaaa

SEQ ID NO: 27 - RNA, 223 nt, Glycine max
  misc_feature (1)..(223): gma-miR4348b
uagaaaguaauagucaaacucaaaagauauugaaagauuauaugcuagacuuguaggauggugauauuguagugguuauagauauaaaagugacuuucuacauguuuaaagcuauaaccaauguaaaaaguaaccuacauucacaaucaccauaauguguggucauuuuacaaguuugacacauaaucuuuuauuaucuuuugaauuugacuauuaguuucua

SEQ ID NO: 28 - RNA, 128 nt, Glycine max
  misc_feature (1)..(128): gma-miR9729
uucaaguaaugaguagaaacauuuagaagaguucgguuacgcaauaauaaugauaucucugaaaguugaauuuguauuuugcuugaaaguauuuaauuuuuguaaauguuuuuacucauuauuagguc

SEQ ID NO: 29 - RNA, 109 nt, Glycine max
  misc_feature (1)..(109): gma-miR1514b
cuuugcuauuuucauuuuuaaaauagacauugggcuucuucuuguuccucuuuuuuccuuccaauuccgauuugguccuaaugccuauuuuaaaaugaaaacaaugaua

SEQ ID NO: 30 - RNA, 104 nt, Glycine max
  misc_feature (1)..(104): gma-miR4373
aaaaaaguugacguacguacggauugacaauucguaugguucauaaggaucaguaauccguauggccauacagauugucaauccguacgugugucaucuuuuuu

SEQ ID NO: 31 - RNA, 58 nt, Glycine max
  misc_feature (1)..(58): gma-miR4396
aaauauguaguuucuaagacgaugcugacguuagcccugucuuagaaauuacauauuu

SEQ ID NO: 32 - RNA, 54 nt, Glycine max; identical to SEQ ID NO: 18
  misc_feature (1)..(54): gma-miR2107

SEQ ID NO: 33 - RNA, 113 nt, Glycine max
  misc_feature (1)..(113): gma-miR5225
uuuagggacuccugucguaggagagaugacgccuucuguuagguaauuaauauguugcaaagccaacuugaauuagcaguagcugucaucuuuccucggcugaagccccuuca

SEQ ID NO: 34 - RNA, 130 nt, Glycine max
  misc_feature (1)..(130): gma-miR408d
aaggcugggaacaggcagagcacgaauggagcuaucaacagaaaauggagaagugagaaaugagaggagagaaagagagagaucuguuagggcuacgcucaugcacugccucuucccuggcucugucucu

SEQ ID NO: 35 - RNA, 170 nt, Glycine max
  misc_feature (1)..(170): gma-miR2118a
aagggaaagggagaagagcuugaggaagugaugggagaugggagggucgguaaagaauauaucugagacucgacucaaucucgaucucucucaguguuguguuguuuuguuuauccuuuugccgauuccacccauuccuaugauuuccuucgguuccucucuuuccacuc

SEQ ID NO: 36 - RNA, 151 nt, Glycine max
  misc_feature (1)..(151): gma-miR167i
caacuacuaggugaaacugccacaugaucugaucuuuccacggcaagugagggaaguuaagaucaugcuggcagcuucaacugguaguggugcaugaugguagacagauauugggaagaacaagaaccagaacaaguguucuaaaagguaa

SEQ ID NO: 37 - RNA, 115 nt, Glycine max
  misc_feature (1)..(115): gma-miR1531
aagucuucccauauggacgaagagauagguaaauguugaaguaggccuguggguuucuuggcuucaaccuuuaccaaucccuucguccauaugggaagacuugucucucgacuuc

SEQ ID NO: 38 - DNA, 1800 bp, Glycine max
  misc_feature (1)..(1800): Glyma.13g207200.1
cggagtcaagccttacctaggcggagccaaaagttctcgataaacagctgctcggctcattctcatccctcgttgttacttagtgcaggtaagttaagaaaatggtatccatttcccaagcacaccattgacttggtacagtttcgagggcgcatcatcatcaccgattcaccgatgggtgacgcgaacttcgccttctttgttctctttcttcttcccgtgtttcttctggcggtgctctacttcctggtccgtccgcgtcccgtgaagatcccgattaagaaccggcacgttttcatcacgggcggatccagcggtatcgggctggcgctggcgcaccgcgcggcggcggagggtgcgcgcgtctcgatcctcgcccggtcaccggacaagctagaggaggcgcgcaacgcgatccgcctcgccacagggatggaggtggcggcattcgcggcagacgtgcgggacttcgaggcggtgaagcgcgcggtcgacgatgcgggccccatcgacgtgctgctgctgaaccacggcgtcttcgtggcgctggagctggataagatggaactgagtgaggtcaagttcaccatggacgtaaatctcatgggaacgttgaatctcatcaaggccgcgctgcctgcaatgaagaaccgcaacgatccgctgcccgcttccattgctcttgtttcctcacaggccggtcaggtgggaatttatggttatgtagcttattcggcaagtaaatttggtcttcgtggtttagcagaatcattgcaacaagaggttatagaagataacattcatgtttctatgatattccctccagatacggatactcctgggttagcagaagaaaacaagagaagaccggagctcaccaaaatcattacagcctcctctggttctatgaaagctgatgaagttgctcagaaagctttggatggtataaaatgtggcgattttattgtttcttgcaatttcgagggaattgcactatccctagcaactgcaggtttatcccctcagaggtctttcttaatggcgtttcttgaggttgttgctgctggaatcctacggattgttgcactaggtatgcagtggacttggtatagaagtatagagaaatatcacagccaaaggaaggaggtcaagccttcgttgataaagaaaatattgaaatggtaatttttatttagctttgggcttgtgtctaaaaagcactatctggcatgagaaactgcatatacaagaacacaacacacagcaaaatctgaagtgttccactaggatttgaagtgtcatgtctgattcaagtgtacgtgtctgacatgtgacaccaactggcatgagacaacatatacgagaaggactacgaaggactaagaagtactaactcaagtgtttgaaatggtaaattttatttagcattgaacttttgtctaaaaagcaccaacggacacgagacacagcatatacaaggacacaacacacttcaaaatctgaagtgtcccactaggatttgatcaagtgtatctatacatgaccttcctttaatgtgtctgtgcttcaaaggttctgttgctggctatttttataattaaaatccatacttatctttgttgctgacaggcctctctggcttattcaacgcaatagtctgttagaaatgaaaatattccgtgtcagtaaaacagctagcatctcaacaatgtatcagtgaaatcagtactgtaaagtgtacattattttgtgtttatataatatatttacattttaataaatgaatttgattttgacttc

SEQ ID NO: 39 - DNA, 3214 bp, Glycine max
  misc_feature (1)..(3214): Glyma.11g135300.1
tggtgggcccaaggcctccgtccaacagcctggtagcaccgaaacgccaacacatccatctcgtaacggaatctgaaatttccgtcgtcgaagaatgaagacgaagaagcaagacacggcgaagctgatcaccgccgaggatttcgaattcgtcatcgacaaagaaagtgcgacggtttcacataacattcacaacaattttacctctccaggtttctactttccgattagggttttaggattagcattgttgaggcatattatgatggaagatgattcataaagcaaccaaaaccaatcgagaatactttgattccgagtgaaatgcggcattggaaacaattgggagaggtgctggtggcagcttctatcaccaacacgctatcccactctcactctgcaactatcaacctccctcctaacctcgctctcggactcacccaacccctcattctaaaaatcctctcaaaccccgcgcatcacgcatcccacaagcttcgattcttcgagtggtctcgctcccaccactgcccttcccccgccgcgtactccgtcatcctccgcaccctctcccgcgagggtttctactccgacatcccctccctcctccattccatgacgcaagccggcgtcgttctcgatccccactccctcaaccacctcctccgctccttcatcatctcctccaacttcaatttagctctccaattactagattacgtacaacaccttcacctcgaccctagcccaatttacaactctctcctcgttgctctgcttgaaaaaaaccaactcactctcgcgttatccatcttcttcaagctccttggtgctgttgattcgaaatccatcaccgcgtgcaaccagttgttggttgctcttagaaaagcagacatgagggtggagtttgagcaagtgttccagaggttgagggagaagagagggttctcatttgacacatggggctacaatgtgtgtatccacgcctttggttgttggggtgatttggctacttgctttgcactttttaaggagatgaagggtggtaataaggggttcgttgctcctgatttgtgcacctacaacagcctcatcaccgcactttgcaggcttggcaaggtggatgatgcgatcactgtgtacgaggagctcaatggctcagcccaccaacccgatcgcttcacttacaccaaccttattcaagcctgttccaagacttacagaatggaggatgccatcaggatttttaaccagatgcagagcaatggattccgcccggatacacttgcttataactctctgctggatggacattttaaggccacaaaggttatggaagcctgccagctgtttgagaaaatggttcaagaaggtgtgagaccgtcatgctggacttataatattctcattcatggattgtttaggaatggcagggcggaagctgcttatactatgttttgtgacctcaagaagaaaggccaatttgtggatgggattacttacagcatcgttgtgttgcagctttgtaaggagggccaactggaggaggcgctgcagttggtggaagaaatggaaagcagaggttttgttgttgatcttgtcaccataacatcgctcctgattagcattcatagacacggtcgctgggattggacagaccggcttatgaagcatatcagggaaggtgatctggcactttccgttctcaagtggaaagctggaatggaagcttctatgaagaacccgcccggcaagaaaaaggattactcgcccttgttcccttccaaaggagattttattgacatcatcaacttcatgacctgtgcccaggataccaccaacattaatgacggggaggaaaattcctgcaatgaaattgacgagtggtcatcatcaccgcacatggataaattggccaatcaagtgagctccactggctattcttcccagatgtttactccttctcgtggacaaagagttcaagaaaaagggccggattcttttgatgttgatatggtgaatactttcttgtctatatttttggccaagggaaagttgagcttggcttgcaaattgtttgagattttcagtgatgcaggtgtggatcctgtgagctatacttataattctatcatgagctcttttgtcaaaaagggctatttcgctgaagcttgggctattctaactgaaatgggagaaaaattttgccccactgatatagccacatacaatatgataattcaaggtttaggaaagatgggaagagctgatctagccagtgctgttcttgataggctactgaggcagggtggttatcttgacatagttatgtataacactctcattaatgctttggggaaggcaagccgaattgatgaggtgaataagctttttgagcaaatgaggagcagtgggataaatcctgatgttgtcacttataatacattgattgaagttcacagtaaggcagggcgattgaaggatgcttataagttcttaaaaatgatgctggatgctggatgcagccctaaccatgttacagacaccactttagattatctagggagggaaattgataaattgaggtaccaaagggcatcgattttgagtgaaaaagatgatccttcttgagaagtcaaagttgcatgtaactcaagtgctggcctgctggggatgggatgaaattctagcagactatgaaattggaatttgtaattcagtttttgcattgtctgaattgtgtttgtggtcttctcaattctcatgttcctgtgatctcaggcagtgtacttcatgatcaattttgcagtgttgtctctgcttcttagctgattagggtgatgtgggtacttgggtgaagctctgatcttgttgccagagtttcgtgagaaggaggtgatgcaccataaagaggtcgacactgatgccgagctgttgggaactactggacaccacttatacgcagaaacaggcttttacctttactaattactaccttatcgtgtgttgttggactaggtttttacgttttgatgtaagaagtattttattaaattctgaaatctttttttataatttaaatagaaagttacgtgttagaaaataatactggaaagaaaaataaaaaagtaatagcgactagcaagtgcaaaaaactaattgttcatgtcgtgttgtgccaattgagttaaagacatgagaccttctttaatac

SEQ ID NO: 40 - DNA, 3606 bp, Glycine max
  misc_feature (1)..(3606): Glyma.17g031900.1 s
aataatttaacgcataagagtcagactgtagaatagaaaacagaaaggaacaggaaagagtgtcattcagctccaacgaggcgatcatatttctctgcaatccgaacagacccacccttctctgcaattagttgctgagttttaggtgagagaaaagtgttcggaatttcccaaggtttctgtgaatatggcgaataacttagcggcgcaacaactggttggttcagagatacatggattccacacattgcaagatttggatgtggggagcattatggaggaagcaagaaccagatggctccgtcccaatgagattcatgccatgctttgtaattacaagtattttaccattaatgtcaagccagtgaatttgccaaaaagtggtactattgtcttatttgatcgcaagatgcttaggaacttccgtaaagatgggcacaactggaaaaagaaaaaggatgggaaaaccgttaaagaagctcatgagcacctaaaagttggtaatgaagaaaggatccatgtatattatgcacatggccaggataacccaaattttgtccgaagatgttattggctgcttgataagagtatggaacacatagtccttgttcattaccgtgaaatacaggagatgcaaggttctcccgtcactcctgtaaattcacactccagttctgtctctgatcctcctgcaccatggattttatcagaagaaatagattcaggaaccacaactgcatatgctggtgacacgagtgccaatataaatgtcaaaagtcatgaactcagacttcatgagattaatacacttgattgggatgacctggtggatgcaaatgatcataacacaactactgtgcctaatggaggtactgttccatattttgatctacaagatcaaattttactgaatgacagtttcagcaatgtagccaacaatctatctgcagacattccttcttttggtagtctcactcagcctattgctgggagcaacagtgttccttacaatttttcaagtgttaatcttcagacgatggacgatcaagcaaatccacatgagcagaggaataatacagtttccttaagtggtgttgattccttggacactttggtcaatgatagattgcaaagtcagaacagctttggaatgtgggtaaaccccatcatgtctgattcaccatgttcagtagatgacccagctcttgaatccccagtttcatccgttcatgaaccatattcatctctgatagtggatagtcagcaatcttctctgccaggacaagtatttactatcactgatgtatcccctacatgcgtatcttccactgagaaatcaaaggtcctggtgactggattttttcataaggactatatgcacctttcaaagtccaatctattatgtgtctgtggtgatgttagtgttcctgcagaaattgttcaggttggggtctaccggtgctgggtatcaccacattctccaggattcgtgaatctctacatgagcattgatggccataagcctattagccaagttgttaattttgaatatcgtactcctgctttgcatgatcccgccgtttcaatggaagagagtgacaattgggatgagtttcaactacaaatgaggcttgcatatttgctctttaaacaattgaaccttgatgttatctccactaaagtatcacccaatagacttaaagaggctagacaattcgccctcaaaacatcatttatttccaatagttggcaatacttaatcaagtcaactgaagacaaccaaattccattttcacaagcaaaagatgctctattcggaattgcattgaaaagcagactaaaggaatggcttttggaaagaattgttttaggctgcaagactactgaatatgatgctcatggccaaagtgtaatccatttgtgtgcaattttgggatatacttgggctgtttccttgttttcatggtcaggcttgtcattggatttccgtgataggtctggatggacagctcttcattgggcagcatattgtggaagggagaaaatggttgcaactctgttgtctgctggggcgaagccaaatttggtcactgatcctactccccaaaatcctggtggatgcactgctgctgatcttgcttatatgaggggtcatgatggcttagcagcttatctttcagaaaaatctctggttcagcacttcaatgacatgagcttagctggaaatatcagcggctcacttgaaactagcacgactgatccggtaatttctgcaaaccttacggaggaccagcagaacctgaaggatacattggcagcttaccgaactgctgctgaggcagcttcccgcatacatgctgcatttagggaacactctctaaaactgagaactaaggcggttgcatcttcccatccagaggctcaagcacgcaaaatagttgcagcaatgaagattcagcatgcctttaggaaccacaagacaaagaaagtgatggcagctgctgctcgcatacagtgtacataccgtacatggaagattcgtaaagaatttctcaacatgcgttgtcaggctgttaaaattcaagctgcgttccggtgctttcaagtgcggaagcattattgcaaaattctttggtctgttggtgtcgttgagaaagcagtgctgcgttggcgtttgaagagaaggggtttccgtgggctccaggtcaaaactgtcgaagcgggaactggagatcaggatcagcaaagtgatgtagaggaggaattcttccgggctggtaggaaacaagctgaagaacgtgttgagagatctgtggtacgtgtgcaggctatgttccgttcgaagaaagcacaagaagagtacaggaggatgaaattggcccttgatcaagcaaagcttgagcgagaattcgaacgacttcttagtactgaagttgacatgcaactgaagacatagattacccaaaaagattctaaattttgggatgcagtatccagtagattttgtaagtcccccttgactctttcagactttcttagtatcctagaatgggtcattatataaagttttcatctgtcattgggctctctatggttgtaacttctgatgcaaagatactgtgccaccccaaagtttaatatacagaatactagaatagttatagctataagcctggtctggggatggtaatggcttcttcgtttcttttaactcaaaaatagcagaggcaaccaaagatcagtgcgattttttttattattatttataggcgccaacacatcttcaatattagcccatatttacaaagatactctttgtttcttaaatcaccatatccaatatcagttatctctctagattaatgataaaatttattatatgatactccccaatattatgttagttaaaattttaaatccaaattcaaaacaaattgtagcaatatcaaagagcacgagataatccaatgtcatttcattggtgttatttttatggacacggttataattcttaagactatagggttagatagggatgagtaaagtttggtcacaattttagtggctttgtttctatatgaagctgccttggtagtgcgtgcttcc

SEQ ID NO: 41 - DNA, 1959 bp, Glycine max
  misc_feature (1)..(1959): Glyma.02g141500.1
ctctccatctgtttctgtttgaagaaatcgaacaaaataaatacaaggttacgtttgagaaaaaaagtaaaaaaagaataataaaaagacaaaccagtttgtgagcttggttaatgcttttttattttcctctcgattgagatcaacctcaacaacaacaaacaccaacgctgtccgaatccaacaagctccacctaaatccacgtccaatctcaccgacccatctcgttttttcttatcagtcttcaccgatccacacttggctacactacttaggtgattgtagcgaagaagtggacgtaaatttgcatgcagtgataggaggattcatatatacgtgggtgaaggacgttgatgatgacgatgaagaggttggtgagagtgaagagggatgcgattgcagcatgcatgacttgcccgctttgcaaaaagttcctcaaagaagccactgctatttccctttgcctgcatacgttttgcaggaagtgcatttatgacaaaattacagatgaagaattggaaaattgtccagtatgcaacattgatttgggcattgttccgcttgagaaaatgaggccagataacattttgcaagatttaaggaacaagattttccctttcaaaaaaagaaaggagaaggcacctgtatctgtctcttcagtactattaccagctagaagaaaggagagatcactgtcgtctttggttgtcagcactccaagggtatgtacacagtcaaccatgacaggaagaagaacaaaacctgcaagaaaggctagtggcctgcagggatctagtttatccattgagaagttcattaaaaaagaagaggaattactggaagatcaccaagataatttgtgctcacctgacacttcaaacaagtctgctaagaatggtgggcagagtttgtcaccttgtaaaaatagccaatccatatgcaatagagaaccacagaatggcgctgaaccacaggaagcaaaatgggatctttggaaaactttgaattatttagcagaggctgcaagtaggagtaagccttttaagtctaatgtgcaagcgtctgatgctaaactagaatctatgaaaatgactgatagtgatgctaaagtgctgaaagccaaaattaaggaaaagaagcgcaaggcaaaagttgaagaagaaaagattagcactgatcatgcctcttcagatacatcaaaacccaacaaattgcgaagagttcgccaaaaaaaggaacctgtttttggagaatctagaatatcacctcaggctgttctggatgctaccgacagaaatctcttatggaatgattcaatttggttctccttagcagcttctgaaaaccaggaaggagatgcacctttaccacaaattccttcaaattatgtaagaataaagaacggaagcatacctgtttcctttatccaaaaattattaatgaagaaactaggcctgaaaagtgaggatgaggttgagattaaatgcatgggacatccagtgcttccttcactgcaggtgcaaaatttggttgacctgtggggggttgatacagcgtctttgggacatagaatttcagcaaccattggatcctcagggaaagattttgtcatgatcctaacctatggtcggaaggtcctgcacccttgatcgtggttcccaattctgccctttctcatttttattatagcatgataaataaataaaaaaaacgtcagagaataatcgcttcctcgtcaacgggcgtttttatgtagctgttgccaataagcacgcagttatgaggaaatctcctctcctgctagactgttgaatgtagagtagcatgctgttctgttggtcattgtagtgatcattggtctctgatttttctatagcatgttttttgttttcatacttgttgctacagatggtttcttggatatttgacatttcaatttagatcgccttttcgtatta

SEQ ID NO: 42 - DNA, 1191 bp, Glycine max
  misc_feature (1)..(1191): Glyma.18g157300.1
attgcttgttgcacctagcatatcccaaagtgaagctgtatcaggtcagatgtgggtgagcttgcaagaaagcccaattggggcccaattggttgacccgtaatgaggcggggtctgtatccaacatatcaaactagggtttcatatatattcagggttttatcatagaggggggcgcacccagagaggaggaagctttgagagagagagagggaggagggagagtgttgacgctccatcaagatgggtatttctagggattccatgcacaagaggcgtgccactggtggcaagaagaaggcctggagaaagaagagaaagtatgagcttgggcgtcaggccgcaaacaccaagttatcaagcaacaaaactatccggaggattcgtgttcgaggtggcaatgttaaatggagggcattgaggttggataccggcaattactcatggggtagtgaagcagttactcgcaagactcgtattctagatgttgtttacaatgcctcaaacaatgagcttgtgcgaactcagaccctggtcaagaatgctattgttcaggttgatgctgctcctttcaagcagtggtaccttcagcactatggtgttgaaattggtagaaaaaagaaagtggcatccaagaaggactctactgaggagggtgaggctgctgctgaagaaactaagaaaagtaaccatgtccagagaaaacttgagaaacgccagaaagatcggaaacttgactcccacattgaagagcaatttggtggtggccgattgttggcctgtatttcttctcgtcctggacaatgtggcagggctgatgggtacattctggaaggtaaggagctggagttttacatgaagaaactccagaggaagaagggaaagggtgctgcttaattttagtgttttatgaacttctatttggctttagttcttggaagttggtacaattcaagatgtacgctttttgactgttggtcgatctcctttagggtgatgccataggacatccttagtgtgaacgttttattagcgtacatcttgaatttgagacagggatgcatgagtattctacttgtcattaccatatcatcagataagagaacaaaactgcgctgattttgaaattactgattatcctatccataatattctctctcacaatggtagtagaaatatttttttaagggt

SEQ ID NO: 43 - DNA, 2356 bp, Glycine max
  misc_feature (1)..(2356): Glyma.14g190400.1
acaccaaccctcccatcatatctaatctaaattctacctattcctatctatctgaacagagcagaggagagagagagagatacacagtcacacacacaacacaaaacacaaagggtctgtgtttgttcttctgaaaagtccagctttctccaccacctctctagggttcctttgctttcaatttttgcttaaaaatattatttttatagtttttctgaaaaaagcaacagaccccttttccttaccgatcttgtcctctctctgtatttcttgccgtatgcagctgaatttgcagaactgaactaaagcttccttcatcatattgtccaacagcttattcaggagcaaaagtagaggcagtttaaagatgggttacttatgtgatttttgtggagaccagaggtccctggtgtactgccgctctgatgctgcgtgcttatgtttgtcgtgtgatcgaaatgttcattctgctaatgccctttctaggcgtcattcgagaacccttgtatgcgagagatgcaattcgcaacctgcatttgtgaggtgtgttgatgagaagatttcactttgtcagaactgtgattggttgggtcatggtacctcaccatcttcttcgacacacaagaggcaatcaatcaattgctactctggctgcccttcagctgcagaattttcttcaatatggtcctttttcttagacatcccttctatgggtgaagcatgtgagcaggaactaggtttgatgagcattaatgagaacagcaataagaatgcttgggcttctccagaagggcagaatgtgtctggttcagctgaagtgactgatctacccagcaagggtaaatcttgggctggcacatcttcagtacctgagtcaagctcagaacctcgtattctagaccagccgcctggacctgccaatgaatgtatgcccaagttgtactgtcctgggaagaaagtttctggaatatatgaagatgatgatctatatgatgatttcatcatggatgaagtggatctacaacttgagaactacgaggaactttttgggatggctctcagtcactctgaagagctttttgaaaatggtggaattaatagcttatttgagacaaaggacatgtctgctagtgctggtgattcccattgtcagggtgctgttgctgctgagggatcgtctgctgagttggtcaatgctatccaaccagcatgcagcaatgcagcatctgcagactcaatgatgagtacaaaaactgaaccaattgtttgttttacggcaaggcaatctctatcaaacatttctttctctggtgttaccaaagatagtgttggtgactatcaagattgtggtgcttcttcaatgcttctcatgggagagcctccctggtgtcctccttgccctgagagttctctgcattctgctaaccgcagcaatgctgtcatgcgctataaggaaaagaagaagacccggaagttcgagaagaaagtaaggtatgcctctcgcaaggctagggctgatgtcagaaagcgtgtgaagggtcgatttgtcaaagccggtgatgtctatgactatgaccctttgaaccaaaccagaagctgctgagtgtacaacttttaaccgtgttctataaaaggaaagaatcactctatagttgcaaaagaaaagtaactcttacctgaaaaaatggatgaaatttgatgcattctttctccatgcaatgacaaggtgtctgattttatgacaggggcataaattttcttcaaggggaagaaggttgtaagcaggcccttgtccaatgaaattgacagtgtaaaagctcaggagcagattgtgtgtccttcactgcaatggacaatcccagttgcaatttcagctgacatgacagcagcatcacaaactgcccccttcatgcaatgtgtcatgaattttggttgcctttctgtttaacttggcaaatcctgcttcttaattctaatctaatgcaaaattctttttaagccctttagccttgattttgctcatagtttgtcatattttatgtcaactcctcactgatcctaagtcacatatacaagtgcctatgatggcatgataagtggctcaatttgataagttctagacaatcttctacactgttgtaggctgtaatattttgtccctctctccttgccatgtatagtgcagaatatacataaatgcagttagaggcgtaatggcccaacagtttcttaggtatgacaaattgtaaattcgaaggttatttatgtatagaataggatgctgctatttattttgatgacacgaaacattctatattttggacatgtgtcatgtatccataaaaattttgtttgt

SEQ ID NO: 44 - DNA, 1367 bp, Glycine max
  misc_feature (1)..(1367): Glyma.05g020900.1
ttcctcgaaaaatcacagatatcttgctagggttttaggaaaagacactgtctcgcgagtgaacacaggttacagcaatggctttctttggtagaattgggaatttattaagacagacagcaagcaggcaggttagttcagaattgcgatcatccccttcgttttttcaggctatacgcagtatgtcatctgctccaagcacaaagctgtttatcggaggtgtttcatattctactgacgagcaaagtttgagggaagctttttcaaaatatggtgaagttgttgatgctaggataattatggatcgtgaaactggtagatccagaggatttggctttattacatacacttcggttgaggaggcatcaagtgccattcaggccttggatggtcaggacctacatggtcgcccgattagggtgaattatgctaatgaaagacctcgtggatatggtggcggtggctttggttcatacggtgctgtaggtggcggtggctatgaaggtggtagcagctatcgtggtggttatggtggtgacaactatagtcgaaatgatgggagtggttatggatatggtggaggcaggtatggatcaggcggcaattatggggacagtggctctggcaataactattcaggaggctatgctggtaatgccggtggtgtaggcaatcatgaaagctctactggttttgccagtaatggatatgatggaagtgttgtggatggtggtgttggtgcaggtagtggcactagctttgctgatggctatgatggaagtgcggggtctgaatttggcagcagtggccaattagatagcaaagcaagcagcaaaggagatgaggattttggtgattacagggatgacaacgatgcagatgattttgccaagagggcttgatggaatttaatagtttttagttttctactgctcgtgttctgtatcctacctcttcctaaaatctctatggacttcaacctggtgagcatttctggcaagttatcttgatcagctggacatggatgggaacaacgttatctaggtccatcttaagcgtctttcttcccttattttcttaagagtcagatatctcgtttttgttgcttactttgaggtgattgtattaaaccaaattgagatattcatacagcatgtaaatctgtgaattgttgcaagtcgggacaacagtttgagacttatgtgggaattcatatcaagtggtttagttctggacgaaataacatttttaaactgtcatttgaaatattactcctcccttgccatgacccctttttgtcttggcagcggacgtgaattgtttctgctaatacgcgataggttttagtctacaaatattatatcatt

SEQ ID NO: 45 - DNA, 2521 bp, Glycine max
  misc_feature (1)..(2521): Glyma.16g128600.1
attggagagggaggggtatcatccgaaccccgtcccgttctcactgtctcattcaaagcgttttcgaccctctccgaccatgggaacctgcttttccgccaccaaagtcagcggctcccacggcaacgccgtcaccgtcaacaagaaccgcaagggggccgcgaagccgaaatcagagacggcaacggcgaatcccctacggcacaaggcaagttcgcgccacgtgccgtgcgggaagcgcaccgatttcggttacgagaaggatttcgatcagcgttactcgctcggaaaattgctcgggcacggccaatttggttacacttacgttggaatcgacaaagccaatggcgatcgcgtcgccgttaagaggcttgagaagagtaagatggttctgcctattgccgttgaggatgttaagcgagaggtcaagatattgaaagcacttactggccatgagaatgtggttcagttctataatgcttttgaagatggttcttatgtgtacatagttatggagttgtgcgagggtggagaactgctagatcggatattggccaagaaggacagtcgttatactgaaagagacgcagcggtggttgtaaggcagatgctcaaggttgcagctgagtgtcatttacatggtttggtacaccgggacatgaaaccagagaattttctttttaaatcaaccaaagaagattcacctttaaaggccactgattttggtttgtcagatttcataaaacctggaaaaaagtttcatgatattgttggcagtgcttactatgttgcacctgaagtgttaaaacgtaagtctggtcctcaatcagatgtgtggagtattggtgttattacatacatattgttgtgcggaagacgcccattttgggataagactgaggatggtatcttcaaggaggtcttacgtaagaagcccgattttcgtcggaaaccatggccaactattagtaatgctgcaaaagattttgtgaaaaaattactagtaaaggatcctcgggcgagattaactgctgctcaagctttatcacatccatgggttagagaaggaggagaagcattggagattcctattgatatatctgtcctgagcaacatgcggcagtttgtgaaatatagtcgattcaaacaatttgcactgagggcattggctagcacacttaatgaagaagagttggctgatataaaagatcaatttgatgctatagatgtagacaaaaatggttcgattagcctggaagagatgagacaggctcttgccaaagatcttccttggaaattgaaagaatcacgtgtactagagatattgcaagcgatagacaacaacactgatggtctagtggatttccgggagtttgtagcggctacattacacgtgcatcaattggaggaagactctgacaagtggcagcaactgtcacaggctgcttttgagaaatttgacctagataaagatggctatattactccggaagaacttagaatgcatacatgcttgagaggctccgttgatcctttgctagaggaagctgatattgacaaagatggaaaaataagcctaccagagtttcggagacttcttagaactgcaagcatgggttctcaaaatgtttcaagcccatctgttcatcggcggcagaggttctagattagaggtgcttcagaggctgagataagtttggagaaacgagtggtggagttcctctaagtaacttattgtgtgattgtgctgagtctcttaagactatcttctatcatgcagattgacaatctatgatactcaaaactccagttttggactgtggtaatcccctgcgcggggattatgtccacaatgtcacgaggactacatcaagaagtgtttggtagagtttatgtagacgattcatggactggcttcaggtatattgcagtttcagcagtatcatttatgtgtcggagttttcttggttgtggcatgcaagtaatgtgtaactacaaataaaatcttctagccaaaaatgaaaaaaaaaatataaataaacatgaaatgaaatacgtggatcaaattctgttctcactatttttccatctcattcttattttattcctctgcagaaaaagcgattacatcctgctgttcttagtagatactaatgaaatgattgcataaatttggtgtactagtttgagtctgaaatgtatttatgtttatatttatttatatatagttctcttctctgaagaattagtgggggggcaacaatgtgattgtggattgatgacttaagggagtggttgatgtctctgatgacttgcattggaggtcacttgtgggtatgtgctcttgctgtgtttctattattatgaatgatatgacaggtttttatttgtaatagcaattgaagcgagaagtggctaggacgaatgatgcatttttcatgcatcgtttgttgaatcatattctgttctagcctcgtatacagtacatcaaggctttcttattatgggaaattgatttctg

SEQ ID NO: 46 - DNA, 4413 bp, Glycine max
  misc_feature (1)..(4413): Glyma.15g275000.1
aatgattgagggtatgatgtagaatgtagatccgttaggttttaagcttcaactccacacactttccctctctatgtttatgaagctgtcggtgtcggcatattagtcaagttcgtaattacattgtccctttcgtcatgcctaagccatttgagtattttttatatacattttacagctatgcacatgcaatggaagtagaaaaaagaaagcttaaactttgagaatagacacaacagacagagagagaaacatttttctatcattactctctctctctctctctctctctctgtcggtcaatttttttcgatccgggtctcttttattcagttctgaaccttgtggagtgttgtctcattccttgatgggaattgctgaattggggtgctcctgattctgtctcttcctctctcactttctttgagtttcattgtgatccagttattgacttcattggccaggaatatcatctggggttgtcacaatctgagtgatccatctacttttgtggcaaagattgctcttttgaggtcttattcagatccggacttcaatttctataccaagagaaggagctgcttctgaagtttgactaggagtgtattagaagagaggaatcttccaaactgatccgtgcaattggataatacacaaggcttttaagtaatgtgtgcatcttgttgagcttcaactatcttttgatccgttattggcatctggatagagcttagtaagagtcaatgacggagtcagaagaagctggggcaaagccaatgaacacattgggtggccaagtctgccagatctgtggtgataatattgggaacaatgtgaatggcgatcctttcattgcttgcgatgtttgtgctttccctgtctgcagggcgtgctatgaatatgaaaggaaggatggaaatcagtcttgccctcagtgcaagacccggtacaagaggcacaaaggaagtcctgcaattcttggagaccaggaagaggatgggggtgctgatgagggtgctagtgacttaaattacaattcagaaaatcagaatgaaaaacagaagattgagcgcatgttgggctggcaaatggcacatgggcgagcagaggaggctgttgctccaaattatgataaggaagtttctcacaatcacattcctctgctctctggtggacaagaggtttctggagaattatctgcagcctcacctgagaggctgtcaatggcatctccaggtggccgagggaagcgtgtccataatcttcaatattcctctgaccttaatcaatcaccaaatattagggttggggatcctggattgggtaatgtggcatggaaagaaagagttgatggctggaaaatgaagcaagataagaatgttgctccaatgagcacaggccaagctacttctgaaagaggagctggagatattgatgctagtactgatgtgcttgtggacgattccttgttgaatgatgaagctcggcaacccctctctaggaaggtttctattccatcatctaggatcaatccatatcgtatggtcattgctctgcggctggttatcctatgcatttttctgcattatcgaataacaaatcctgtgcccaatgcatatgcattgtggttgatatcagtcatatgtgagatttggtttgccatatcgtggatatttgatcaattccccaagtggctccctgtgaaccgtgaaacctatcttgacagacttgcactaagatatgatcaggaaggggaaccatcacagctagcagctgttgacatttttgtcagtactgttgatccattaaaagaacccccacttgtgactgcgaacactgtcctatctattctttctgttgactacccagtggataaggtctcatgttatgtctctgatgatggtgctgctatgttgacatttgaagctctggctgagacatcagagtttgctaggaaatgggttcctttcagcaagaaatataacattgaacctcgggcacctgagtggtattttgcacagaagattgactacttgaaggataaggttcaaccatcatttgtcaaagatcgtagagcaatgaagagagaatatgaagaatttaaaattcgcgtcaatggacttgttgcgaaggcacaaaaggttcctgaagaaggatgggtgatgcaagatggtacgccatggcctggaaacaacactagagaccatccaggaatgattcaggttttcttgggccaaagtggaggacttgacaccgagggtaatgaacttccacgtttagtctatgtttctcgtgaaaaacgtccagggttccaacatcacaagaaggctggtgccatgaatgcacttgttcgagtctcagcagtccttactaatggacctttcttattgaatcttgattgtgatcactacataaacaacagtaaagccttgagggaagctatgtgctttatgatggatcccaaccttgggaaaaatgtttgctatgtccagtttccacagaggtttgatggtattgataggaatgatcgatatgccaatcgcaatactgttttctttgatataaacttgagaggtttggatggcattcaaggtcctgtttatgtgggtactggatgtgtctttaatagaacagctttgtatggctacgagcctcctattaaacctaagcataaaaagcctgggttgctttcttcactctgtggtggtaaccgaaagaagagatcaaaatctagcaagaaaggctcagacaagaaaaaatctagcaagaatgttgacccaactgtgcccatctttagtcttgaggatatagaagagggggtggaaggtgctggatttgatgatgagaaatcactacttatgtcacaaatgagccttgagaaaaggtttggtcagtctgctgtctttgttgcctctacactcatggagaatggtggtgttcctcagtctgcaactccagaaactcttcttaaggaggctattcatgttatcagttgtggttatgaggataaaacagaatggggaagtgagattggatggatttatggttctgtcacagaagatattcttactggattcaagatgcatgcccgtggttggaggtctatatactgcatgcccaagctcccagcgtttaaaggttctgctcctatcaatctttcagaccgtctgaaccaagtgcttcgatgggctttaggttcggtggaaattctttttagtcgacactgtcccatctggtatggttatagtggaaggctaaagtggctcgagaggttcgcatatgtgaacaccacaatctatccagtcacttccattccccttctcatgtattgtaccttacctgctgtctgtctcctgactaacaagttcattattccacagattagtaacattgcaagtatatggtttatctctctctttctttccatctttgcaaccggtatccttgagatgaggtggagtggtgttggaattgatgagtggtggagaaatgaacaattttgggttattggtggtgtttcggcccatctttttgccgtgttccaaggtttactcaaagtgcttgctggaattgacactaacttcaccgttacctcaaaggcatcagatgaggatggagacttcgcagaactctacttgttcaaatggacaacccttctcatcccacccacgacacttctcatcataaacctggtgggggttgttgcaggcatctcctatgccatcaacagtggttaccaatcatggggtcccctctttggtaagcttttctttgcattttgggtgatcatccatctctaccccttcctcaaaggtctcatgggtcgccagaacagaacaccaaccattgttgtagtctggtccattcttcttgcatccattttctctctgctgtgggtccgaatcgacccgtttacgacaagagtcactggtcctgatgttgagcagtgtggaatcaactgctagagaaataaaagctggcagattgaacaacagctttccactcacctgtgtcaaccaacaacataagcctgatggaatgttgtgtttgtcttccaattcttttgtttacagattttgatatttgcttctgcttgtttaagttatgtgcagttaatggttcatacagaggaaaacatgtttaagtatgtgcagttaatggtccatacagaagaaaacaggcttaagttatgtgcagttgatggtccatacagaagaaatcaaattagaatcaaatcatttaaggttgcttatttttttgtaatactatgaacataccttccattcttttgaagaagctgtttgttttatttataaacttttcatcagaagactgactgtccacatccttgtatacatctttgctatcatgagtttttcttatgttttctttgcaatacaaaatataagtaac

SEQ ID NO: 47 - DNA, 249 bp, Glycine max
  misc_feature (1)..(249): Glyma.12g154900.1
atgccaataaataaacaaggccccctgcgtcctttcttaatagatggagcaatcctcactcgacagctcgaaagcggatcagtacaaacccacgtgatccgtattcgcttacgtaccaggcgtgcttcgtcgtaccctgacaactcctctttcactggcttctacttgtcttttactggcttatttgtacccagcttcatgatggaactcccctcggccaatcgtcactcgacagcagctccgtcctag

SEQ ID NO: 48 - DNA, 1585 bp, Glycine max
  misc_feature (1)..(1585): Glyma.13g277200.1
aaagtctggcttgcaatgtgatattgcagtattgggctgaaacataagtgaggccgtgacaaaaagagaagcccacatgacatgcttctgttgtgtagttgtagcttgagggttttttcgattgaagcattacaccactccactttagtctctcctacttgccacaacccctattgagggtttttaggacgcgtaaaagtgatgccacgtgccctaattcaggacattaaaccatagctagcgtctccttgcgaaaaatgaccataagcttacaggttctaatccctgcctatttattcttcttcatctcttctgtttattaattctggcttttggttcagtttaagggctttgtgaggatatgatctatggcacttgtgtcacagcttccaagtcactgattttcagagcgttagtgttgcagaagccattaaattttcaagtaaaattctcctccaagtgttttcctacgaagataagaatggaaagtaatcttaatcatagcatagagggcaacaataaagcgtctaggggtgccttggttgtcctagaaggcttggatcgttctgggaagtcttctcagtgtagcaggctagtgtccttcttggagggacaagggatctctgctgaattatggagatttcccgacagaactacaaatgttgggcaaatgatatctgcctatctaactaacacatctcagttggatgatcatactattcatctcctcttcagcgctaatcgttgggaaaagaggtcattgatggaatcaaaactgaaaactggaacaaccctcattgttgaccgttattcttattctggggtggctttctcatctgccaagggacttgattttgaatggtgtaaggtcccagagattggattgccagcaccagatgtggtagtataccttgacatatctccagagaaagctgcagaaagaggagggtatggaggtgagagatatgaaaagctggagtttcagaagaaagttgctgattggtacaaagttcttcatgatgtttcctggaaggatgttgatgcttgccaacccatagaagatgtggagaaacagttgcaagagattgttcttgattgtgtcacagaatgccggaaggggaagcccctttccaccttgtggtcgaagtagacacgccttgatacatgagaacaaatatgtcagatgtattattttgaacaccaaaacccatttttgtgtaactctggttgctctttttttatatcttataatcacaaattaattcgtttgcgaagcaatttgaagaaagcctcgaaatttataatatgcccaagctcaagctggaaggattgaaaattttctgatccaacaaatgtgatgcagcagctttctgtaaccctgatgaggtccagattttatgtgcccaatttcactgaagtttaactatacatcaggactgcctcaaaagtgtttaatgcttgtgaaactagtaggaaagtattttgggaaaagccaaattgatacgagtttatttatctattaatatgttacctagttattggcaattggatagcctttaaatgaattctattgcctcaagtgttt

SEQ ID NO: 49 - DNA, 1315 bp, Glycine max
  misc_feature (1)..(1315): Glyma.15g115500.1
agcgaatttagttgtttttccaaaatgtagctatatatagcaggtgtaggaaatagtgtacactacgtgaaaaggaaatcgcaagaagaaagcagagcctctactacatcatcacattcacatttcagtaccttctctttctcccagtctctcacacacaacaattgaagaagaaaatggttgacaatgattcgctctcggaattcctcgcatctgcggtcgacgcggctcagaaagctggcgagattattcgaaaaggcttctaccagaccaaaaatgtggaacacaaaggacaggttgatttggtcacagaaactgataaagcatgtgaagaactcatatttaatcatctgaaacagctttatcccactcacaagttcattggggaagagaccacagctgcctatggcactacagaacttacagatgaacccacatggatagttgatcccctggatggaactactaactttgtgcatgggttcccctttgtttgtgtctccattggtctcacaattggaaaaactcctacaattggtgttgtatacaatccaataattaatgagctttttactggaatccatggaaaaggtgcctttttgaatgggaatcccataaaagtatcgtcacaaactgaactaatcagctctcttcttgcaactgaggctggaacaaaacgtgacaaagaaacagtagatgcctctaccgataggattaaaagcttacttttcaaggtgagatctcttcgaatgagtggctcctgtgctctgaatctgtgtggaattgcatgtggaaggctggatgtattctttgaacttggctttggtggtccttgggatgtagcaggtggtgctgtcattgttagagaagctggaggtgttgtatttgatccgtccggtgcagattttgacataacatctcagcgagtagcagcttcaaaccctttcttaaaggatgcacttgttgatactctgcgccaaatggtgtgagaaatttactattaatcaatggcaagaacttatcatataagccatctttgttagttcgtttagcttttgctcaaataattttttagattctcagttttaagtaaaagttgcatgataaaaatgttttagaatttttaacttcttctgtggattcagagtattcaataataaatcactttaaatcctttcaaacaagtacaattccttttatattacattgctaaaatatcagtatattaagaatgttaaaacacgctcttttgatatttttttcatcatcggtgattgggtagagaatgctcccattaaataaaagggttgagtac

SEQ ID NO: 50 - DNA, 2482 bp, Glycine max
  misc_feature (1)..(2482): Glyma.17g044200.1
agaaaaaaaaaagttggtaagaaagaaagtgtagtagggtgggcaatcgtacccaaatttaattaatgtacaagaaagagacgaaaggagaatcgaaaatgatgccctaatttccgtattaaccaacaattagctttccacgtttgttttcaactactttctctttaaattttccattttatcaaccaacgaaaaagaaagattaattaatctattgaaatagtctcagattcagtgcatgtcgtctatttttctacacaccgaatcattcttatataacgaagaaaaccacaaatttgaatctactaactcttaaacactacggatagattgaaggcaatcaaatcatctttatacaaagattcttcttcatcgtctatgttttcctgcatattcagttttaaggttcaagcatcttcttgaaactcttctcaagctcgacgggaatttctcagcttttctctcgttacctcacccatcaaagtttcctcttctgggtgtttgtttatcggatccggggcattgcaagatttgatcatttcacgaatcatatcattatcaaacactcccattttctgggtacttaattgggatgggttgcctcggatttcgcactctcatttctagggtttatgtcggttgcgtttggtggatacccctttgactccgaatgagcttgaccacgaaaagattggttcttggtgatcgcagtgttcaattcaataagttcggggattgattcttttacaaaggggaatattgcctttttttttgctctgagatttatccgttcaatttttttttttatttcttttcttttagtggtgatgcttgaatatcagagcaagattctggtgttattatgtttagattaaggagttgtgaaggccctgtgcgctacttgtatcagcaaactcggcatcaccttcaccataacaacaatattatggcttatttagttggttatgatccttgttcccacttgagcaaggccttttctcagtatccttctcttgcttcttctgatcgtggtagctacctgtctttccgatttctccataatcttgtttatgctgatgtttttggggttagcagaagcattgcttttggtcctagaagttgtagctttgacactagtggtagctgtagtagtactaatagtgataggatctttgtgagggcaaaggcaaggtcccgtggctttgcatcgaattgccgccagccgatgctggctgatttggagcaaaggaattttgttaggagtgatgagagtgatgctactttggttaaggttgataatggatctataaatggatgtcctgccaagcctccttgtttcaatgatcatcgattgtcccagaaacttgtggttgctgttgatgttgatgaggtattaggaaactttgtgtcagctctcaacaagttcattgcagatcgatattcatcaaattattcagtttctgaatatcatgtgtatgagttctgcaagatatggaattgttcacgtgatgaagctgatatccgtgttcatgagttttttaagacaccatatttcaagtcagggatccaccctcttccaggtgctcagatggctcttcagaagttatcaagattttgtagcctatcagttgtaacatcacgacagaatgcaattaaggaccacacaattgagtggctagagaagaattatcctggactgtttcatgagattcactttggtaaccactttgctcttgatggtgtgtcaagaccaaagtcagaaatttgtaggtctttaaatgccaaggttcttattgatgataacccacggtatgccatagagtgtgctgatgttggaattagagtcttactttttgattatgaaaactcatatccttggtgcaagaacgagtctgttgatcagcatccactggtgaccagagttaagaactgggaagaagtggaacaacaattaatgtcactgatagcttcttagtcgttaaaacttgtaacaaggatttgtggaaaaccatcctttttacatgaagttctgcactacatgtgtttgaaatatctaatatatattcttgaaaacttgaactcacttaaagtggctgtaaggagaccactcagaaatggcttgaggccaaagaactataaatgacaggactatattctttttcccattttgagcaacattaaggaagattggaatagggagttgttcattatggtgattttaccatatgtaggagtgaaatctaaatcatattggttatgccatcctacattcaatcttaaccgtcaaattgtattatctctgatgttgaacaatgattttacatgaaataaaagtgcaaaaccatcaggggttttagtcactggattctattggtcttgatttactgttttatctttggtctagttatttttttatccgtcaatattatttgttagttaatgttaaaatattagtgtaggggattcgaactcccgacttttg

SEQ ID NO: 51 - DNA, 2081 bp, Glycine max
  misc_feature (1)..(2081): Glyma.18g013300.1
ggcagtgtgcgtgagaccgtttatataagcttagcaagggtttaagaagtcgaacgagcgagcactgagcagcggttgcaggaaaagccgtgtcagcgagcgtcgcattcacggcgatggcggagacggtgagacttcgcgtggtgttcgaggatcgtggcatgttgagcaagtcaaagaagaagcaagggctcaagcgttgctggtttctgcttaaaccccaacacaccaccatttccgatgttgcctctcatctactcaacactttccgcctccaccgcacctgtccccatggcatcgtcctatcgatggatggttttgttttgccatcttttgagttcacttgcattttgaaggataaggacattgtgtgtgtgaaaagaaaaggaagtgtatcaactgatgataaatctgcaatgctgcggcccgcgacatgtgagaatcaggctattgagcttcagaaacttctcaaaaattgagggccttcaagaggaggagtctggggcagaagaaaccatgtcccaaaaggatgatgatgaccagcttgaagatgcagtttatgtggaatctaaatcggatgggaatgttgtcttcaagaaaagaaaagcttcaaagaagctcaagagccctagtcagaagaagattaagttgtctactgccgaaaacttgtcagtcactcctaaggtccatgagaaggaaaacggaagctctgaaggccatgaggaggaaaacggaagctttgacggctatattcatcaccaattgagtcttgtcaagaaggacaagaagaagtcttccaatttatctagtcagccaaataagtctagcaaccttaataaacaaaagaatgacaaaagtgatcctacaagtgatgaaacaaggtttgtccagcctcaagatgaaagtgaaactaaaaagttgcctagcagaagtgctcggcgaaagaaagctaaaagaagatggctgagggaactaaaattagagaaggagaaggagaagctccatcagactcctgtgcttgaaaaaggtggacaagaattacctatcaacgataataattgtgttgtttctgatgtacatcaacaacctgatgaagaaagtgaagaagaggatgacattgctcctgtggaaattaggccagggcacattcggtttgagccccttaagaaggatcaggatcaggcagtgccacagaatcagtttccagtggaaacatttcagtggaatggaataaccaacaagaagaagggccagaaatggggtaaagagagaatgcctttccgtaagcaggatggatatgaagattccggtcaagattgtcctacagttcagaatgctgaaaaggaacagacatccaatgtgatagattttgataagcttaaacattatacaagcttgcctaaggaaggtgatgtaattgcttatcgattgattgagttaacagcatcttggactccggaactttcctcctttagggttgggaaaatatctcggtatgatgctaaatcaaataggatttggctggaaccagttttagaatacccatttgattttaagaaaaaaatagatgaggatgcatcttctgtacagtatgatccatccccttatcaggaggatggttctttagagatagagtatacattgctggccgatgttcgaatggttaagcatggcattcctgatttgaaaagtgatgctttggttaatccaacaaaagcaactaatgatattaccaatgaaaaacttgcggcaaaagcaattaatggtagcactggtgagaaactcgcgggtgatcaaactactgtgggaagttgccatccagaaagaggtcatatcactgctaaagaaaatggggaagtaaacgtgtgggacaaaattaacgaggcattaaaagcaaagaaggccaagctgtcgcaggaggattgttggagtagaggaggagagagctcaagcacgaggtcatggtcccatagagccatgagatgcagtgcgttgggtcccacaatggcattgttaaggtctaacaatggactttaagaaacaagcctacatctgttgtgtcacctatccgcagtattttg

SEQ ID NO: 52 - DNA, 1441 bp, Glycine max
  misc_feature (1)..(1441): Glyma.04g018200.1
gcaggtgcaaaatcacgtgtgaacctcatccctgtgaatgccgctccacttccaaggcaaactctgaaacctctctggttctctgtgacagcggaacaaattatatgatcatgtattcgttgacactgaaacccttcttcactcctcaattagtttcttcgtcttcttcaacttccacttcgtcctcttcgatttctctcgtgtccttcccatctcgttcggtctcatcaattagctttcccagaaatttaaagcacaaaggaagatttggtctcagagttgaagcatacgattcctccaataatgacacttccaaccctgccagtgctggcggcgactccaaaccccctaatggcactttgtcaaagagcaggagagaaattttactggaatatgttaagaatgtgcagccagaatttatggaattgtttgtgaaaagagcgccacaacaggttgtggatgcaatgcgacaaacagtgacaaatatgattggaacactgccccctcaattttttgctgtaacaattaccactgtagctgaaaaccttgcacaactcatgtacagtatcatgatgactggatacatgttcaagaatgcacaatatcgtttggaattgcaagaaggtttggaacaagttgttgctcttccggatgtgcaagataaaaaggatgtgccagactatgcacctggcacacaaaagaatgtttcaggtgaagttattcggtggaacaatgtttctgggcctgagaaaatagatgctaaaaagtacattgaattacttgaagcggagattgaggagctgaatcgtcaagttgggagacaatctagcaatggacaaaatgaactgttggaatacctaaaatctctcgaacctcgaaatttgaaggagttgaccagtagtgctggcgaggatgtagtgtttgcgatgaatacatttataaagcgcctgctggctgtttcggatcctagccaaatgaagactagcgtgaccgagactagtgcagctgaacttgcgaagctgctttattggttgatggtggttgggtacagcatacgcaatattgaagttcgttatgacatggaaagagtacttggcacccctccaaagctagctgaattgccgccaggtgaaaatgtttaagcagtctggagtaaagtagttcaacaaagtactggtgtctcttagttgaagccaagtgccctaattagattttgcactttttttgttgattggctgaaaggccagtcatgagctcaaagagaagtctgcatttttcagcggccatgaacgattgatctcttaatattattaatatatttgatgaaacttttattcacaattatactgacaaagatatcaaggtcgattccctgaagatgtgctatgcttttatattacttctttgacagcctgaactgtggtgattttttttaaaggcg

SEQ ID NO: 53 - DNA, 3364 bp, Glycine max
  misc_feature (1)..(3364): Glyma.02g211800.1
tttgagcatatgcaattatgattttcgttttttaacgctgagaattaagagcacgatatcgattttatattaaaagaaaaactagtacatattcgtagaagagagccatgaaaaagaaaaaaagtagaaaagcttgtaaaaggaaagggtagtgaaaataaaatctctcaaataatgatgcagagagagacagtgagagaggcatttgatttggatatttgtgatgaaagagagagggaataaagaagaatcccaatgctaaaagctgaggttactgttgtcactccctggcctctgttttgtttttaaaaaattgaaatccccactctctctcctccattctcgtcttcttctcccatctccatttccattcttttttttgagtctccagaacaaaaacaaaaacatcatcgaccgaatccaacaaatgagagacaagtcagagagccatccttcgacaaactccgaggacgaccaccgatcctcccccttgctggatctggcgtgtgccgaaatcaccgaatcctccaacagcaagacccgaacctgcggcccgtttcctggttcgggcccctccgagcctcaggctccgttcccggaccaggtcctcgagaacgtccttgagaacgtgctccacttcctcccctctcgccgcgaccgcaacgccgcctcattggtttgccgctcctggtaccgtgcggaggccctcacccgatccgagctcttcatcggcaactgctacgcgctctctcccactcgcgccaccgcccgcttcacgcgcgtcatgtccgtcaccgtcaaagggaaaccccgcttcgccgacttcgatctgatgcctcccgattggggggcccacttcggcccgtgggcctctgctttggcccaggcctacccctggctcgagaagctccacctcaagcgcatgttagtcaccgacgccgacctcgccctaatcgcggactccttcgccggtttccgcgaactcgtcctcgtttgctgcgagggcttcggaactcccggcctcgccgccgtcgcctccaagtgcagattgctgagggtgcttgagcttgtggaatctgtggtggaggttgaggacgatgaggaggtggattggatttcgtgttttcccgagactcaaaccaatatggagtctcttgtgtttgattgtgttgaggttcctattaattttgaggctttggagggtttggtggctaggtcgcctcgcttgaagaagcttcgattgaaccaattcgtctccatggctcagctatatcgtctgctgcttcgagctccgcagcttactcatcttggaacgggttctttcagtgctactgaggctggggtggtcggggaccaggagccggattacgcggccgcatttgaggcttgcagatccctggtttgcctgtctggattcagagagatttgggcagattaccttcccgcgatttatccagtctgcgcaaatctgacgtcgttgaatttgagctatgctgacattaacacggatcagctgaagtcggttatttgccactgccataagctgcagatattctgggtacttgattcgatacgtgatgaggggcttcaggcggtggctgcaacttgcaaggacttgcgcgagcttcgggtttttcctatggacgcgagggaggagactgatgggcctgtttctgaggtggggtttgaagcgatttctcagggttgtaggaagttggaatcgattttgtttctctgccagaggatgactaatgcggctgtggtggctatgtcaaagaactgcccggatcttgtggtgtttcgtctatgtataattgggcggtataggccggatcctgtgactcaggaacccatggatgagggttttggtgctattgttatgaattgcaagaagctcactcggctggctgtgtctggcttgctgactgatcgtgcttttgagtacattgggacgtatgggaaattggttaggacgttgtcagttgcctttgctggggacactgatgttggccttaaatatgtgcttaaaggatgccctaatttgcaaaagcttgaaatcagggatagtccttttggggatggagctctgagatccggtttgcatcattattacaacatgagattcctctggatgtcgacttgtaaattgacgctccaagcttgccaagaggttgcacgagtattgcctaacctggtttttgaagtaattaacaacaacagtgaggagaatgcgggtgatgaagttgagacattatacatgtatcggtctcttgatgggccacgggatgatgctccaagatttgttaccatcttgcaatagatttttctttttaattcaagaagattttagctcttttcaacgatgactggtcgatgaaacatatggagcaggggattttacataaacctgccagaagatttctctgctgtccatggcaaacaaagttaagcttccaactcctgttcttggtgtgggctgcagtgatggcaggccacaaagctgctattggggagggaggttgggaaaatttctccatatgccctttttatgttagaggattaaggattgaaagagggaatagaataataggaagggggtagggggaggttcagaaaatgaagtcctgcagaattcaatgttgttgtatcgtcaaagtttaagtttatgtattttatttttcttttatattcatttatatcatatcggaaaactgcccaaggagggggaagtagatattgctgaagctgctgaggattggttaataagccttatttcatttccttggtcaaatagatgtacgttgagagcagattcagaaggatcaaatcagaaggttttggagaggtgatgttctctaacttatccatcataccttaccagtagagaagcaacaaatgtgtattcactttgcaaggaacttaatctgtttattttggattcaaaccataattagttgaagctttggcttgcccagaatccaaaccccagactgtgatataaacctatctctgtctccctaatttcaaatgttttttttttcctttctttttttaatgttcacggtccacggatgtgttgctgtaggacctgactgttgaatttattgtgagatggttaataaatgcctgaatatgcatatggaccatattgtgtctatatctctcgttttctgaatgtggaatgatcgacagtgagacctattaattatgtgtgggaagtgttattcaagtacacgttgcaggacccccctttgttctcgtggggttccatttacacgccgtgaggatccatcccctttaacagaaaaggaaaaaagaaatggggtgagggattgtttgatggtcctcatcttcttcagatctt

SEQ ID NO: 54 - DNA, 1622 bp, Glycine max
  misc_feature (1)..(1622): Glyma.14g131700.1
acggaagaaagagaaaaagaaaaacgagaatgacgagatgaatgtagcaaaagatctcatccaaatacgcggattttaattaatattccaacaaggcaaaggagttgacttatttgggtgaacattaccactaaaatatcgcatccgaatgtttcgctcctcgtatcctcctcatccttttatgcgtgtcttcccccaacgaaaccagcgagaccaaacgtggtaacgctttgaatctttgaattcattcaaagatcccccttctgtctccctctctacgcatatcaggcacgtcgttttcaactcccttcttcctttgtttctcgcataaaatgtttattattatctgaattgggttgttgcagggcactatggctgccacggtgaaacaaatgtctttgatcgtgtcactgttcggcgtggtgtccttcattttgggtgttgttgctgaaaacaagaagcctgcggcaggaacacccgtgcctggtttggatggtgtctctgtcacctgcaagtacccagctgatccaactgttgcattggggtatctttctacagcatttcttgttgcatccactgtgactggatatctgtctttgttttacccttacaaaggaaagtctattccacaaggggttctgtttaagcacaccactttcacagtgttcttcaacatttctttgttcaccactggattagctgcagctatgctgttatggccaacaatcaccgaacacattcacctgacacgcaatgtgcaccgcaatatcaactatgaatgtcctacagctaaaactggtctacttggaggtggtgcctttctatcacttgattcatctctcctttggttgattgcccttatgctagctgacaatgctcgcgaggacttctttgaagaagaaggagaagatggtgacaagggtgaatttggcacagcctcctctgatgcttattatgatgctgattcaggaccgaaggctagttcctgaagtatgctacaagtagaaataagtgttgcacctggtatttctgtagtttccttttaatcacgctgaacaattccgtgaaataatgaatgtacatatatttaaaatggttgttctcggtgaacatttattgtgcttaagcactactgcagaaaaaaacatagttgtttgtaaaatggattccttgtcagtaaatctctcattttattccttgaattttacacatttatttaagggggataccttatgatgacgtggatctctttttgaaatgttcatagtatttatttttatagcgtactacggtttctatgtttggaattaactttaatccagtagattccatacgactttgtgtgggatagtagcattataaattatgggtaaaataaagtaaattaaatactccaaacccacaacaattgagaaagaaggatgacatttggcgtttcttttgttgattatcatgtactcaaccctgctattgtttattgtcaaagataggtttgcaattcctactgacttgaaagtggctcccaatattgtttaaagaaatatttatctttataaatctttataataataaaaataaagaagtttgagcgtgaaattcttatacaattgagtgggaaatat

SEQ ID NO: 55 - DNA, 1312 bp, Glycine max
  misc_feature (1)..(1312): Glyma.02g078600.1
cgtggttgcctctaaattccatcttaaagctgcgacgcacgtgaccaaaacgttagcttcggtacacacgtcaactgaagaatccataaggaccataacaacgatatagcttagctaatgaagaagagtggaagaacattgcacctgcaacttcaacttcacttctccgttctaacactcgccatgttccttatcaagacatggagacagacggctttcggtgtttttgggtacctgaatttcaccaaagctggcttccttgatcattctaagaaattcaacccagaggacatggaattacgaataccagggaagaattgcattgttactggagctaactctggaattggctatgcaacggctgagggtcttgcaaagcgtggcgcaactgtctatcttgtatgtcgtaataaggagagaggagaggctgctctttctgacattcaaactaaaactggcaatcagaatgtatatttggagatttgtgacctttcttctgtcaatgagatcaagtcattcgcttccaggttttctaaaaagaatgtgccagttcacgtgttggttaacaatgctggagtacttgagcaaaatcgagttaccacatcagaagggtttgagttgagctttgctgtaaatgtcttaggcacttacaccatgacagaattgatggtaccattactgggaaaagcttcccctgatgcacgtgtcattacagtttcttctggtggaatgtatactactcctttgaccaaagatctacagtattcagagagcaactttaatgggcttgaacagtatgctcgaaacaagcgtgttcaggttgcactaacagaaaagtgggccgaaacttacaagaacaaagggataggattttactcaatgcaccctggttgggctgagactcctggggttgcaaagagtatgccaagcttctctaaatcgctttcagggaagcttagaacaagtgaagaaggtgcagacacagttatctggttgacattacaaccaaaggagaaactggtatcaggtgcattttattttgatagagctgaagcctcgaagcaccttgcatttgctggtaccagtgattctcatgctatgatcgactatgttgttgatagtcttgattccatggcttctccttttgtctaatagtgtacttttaccctgacattaaaccctgaagttgtaaattttaattaatcgtagcacctagttgtgcatcatcaataccaatataacatttctacagttttttttgttgataataacatttccaaagttaatacaataatataactattgttttcag

SEQ ID NO: 56 - DNA, 3014 bp, Glycine max
  misc_feature (1)..(3014): Glyma.16g049600.1
gaaagctgaaatccttgctgggggcctctcagaccccaaaaccctgaaaagaaaaaccccttcttatttattaccgttgccccttcctctcagtgtaggaggaaacgatgagcagttggagaagccttcttctgcgaattggggacaagagccccgaatatggaccctcctccgattacaaagatcacattgatacgtgctttggcgcccttcgccgcgagctcgaccactcccaatccgagattctcgagttccttctcatgtgtgctgagcaattgcctcacaagattcctctgtatggtaccctgattggcttaattaacttggaaaatgaagactttgtgaaacaactagtggagaaaactcaaagtaaatttcaggatgccttagattctggaaactgcaacggggttcgtattctaatgcggcttttgactgttatgatgagcagtaaggttcttcaaccaagctctttggtggctgtgttcgaaacatttttatcatcagctgccacaacagtagatgaggagaaagggaatcccttatggcagccatgtgctgacttttacataacttgcattttatcatgcctcccatggggtggagcagaacttactgagcaagttcctgaagatatcgagagagtgatggttggtgtagaagcttacttgagcatcagaaagcatacatcagatactggcttatccttttttgagaatgatgatgaaaatggggaaggtcttactgacaaggactttttggaagatttatgggatagaatacaggttttatcaagcaacggatggaaggttgacagcgttccaagacctcatctttcatttgaagctcagctggttgctgggaagtctcatgaatttgggccaatatgctgccccagcttaccaagcctgccttcagtcccttctggcgtgtctattggtaaacagaagcatgaagcagaattaaaatatcctcaaagtatacaccggcttaacatatttcctcctagtaaaattgaggatctacagcctatagacagatttgttatggaagagtatctcctagatgtgcttctgttcttaaatggctgtcgaaaggaatgtgcttctttcatggttggcctgccagtttccttcagatacgagtacctcatggcggaaacaatattctctcagctgctgatgctaccacaaccacctttcaaaccagtatattacacattggttattattgacctttgtaaggctcttcctggagcctttcctgcagttgtagctggagctgttcgtactctctttgagaggattgctgatttggatatggagtgtcggacgcgtctgatcctttggttctcacaccatttatcaaacttccagttcatctggccatgggaagagtgggcttatgtcctagacctcccaaggtgggcccctcaacgtgtctttgttcaagaggttttggagagggaagttcgcttgtcatactgggacaaagttaagcagagtattgaaaatgcacctggtttagaagaattgcttcctccaaagggtgggccgaactttagttttggtgcagaagatgataaagaaagcaatgaacatgtactgtctggacagctcaacaacatggttaaaggaaaggcacctgtccgtgaaataatctcatggattgatgaaagtgtgcttccaaataatggtctagaagttaccctcagagtggttgtacaaactcttctcaatattggatccaagagtttcactcatttgatgactgtcttggagagatatgggcaagtctttgcaaaattatgtcctgaccaggataagcaagtcatgctgatagctgaagtgagttctttctggaagagtaatacccaaatgacagcaatagctattgacaggatgatgggttatcggcttgtttcaaatctggctattgtgagatgggtcttctcagcagagaatattgagcaatttcatatgtcagatcgtccttgggagattcttagaaatgcagtaagcaagacacacaatcgtatttctgatctaaggaaagaaatattatctcttaaaaagaatatttcatcatctgaagaagctgccaaggaagcaaaagcagagttagatgctgcagagtcaaaacttacactagtggatggtgaaccagttattggcgacaatcctgctaggttgaatagattgaaatcacatgctgaaaagacaaaggaggaggtggtgtctcttcaagaatctttagaagccaaggaagctcttctttcccgagcaattgaggaaaatgaggcattgtttctcttgttgtacaaaagcttctcaaacgtgttgacagagcgccttcctgaaggatctagaacactgcatgagttgaagtctgcacaagttgatgtggtgatggcagtggaccctgaagagccatcgtcaatggaattagacaaccagaatcagagacctcaaaacagtcatacaaatggcgagaagaaaggtggtgcttataatgtaggtgaaaaggagcagtggtgtatcaccactttgggctatgtgaaggccttctctaggcagtatgctgctgagatatggccccatgttgagaagttggatgcagaggtattgacagaagatgcacctcttctttttcggtcagctgtttattctggtcttcgaagaccaattcacgaggcttgatcaatttgatatttcacttctaagttgtgtttttttagaattaactaaaattcattctttagtctgtcagttaagcattttcttagtcaaccaaaagcgtaaagctgtatgcaattgtaatgtaagtgacaaggttggtatgacgagtctccgctgtttagattctaacgggaacttgaccactgctactgtacattatttcgattatagctactaatttattggaccttaaatacaaagaatgaagtttgtacgcaacccctgtggtgtacttagtaatgcgaaaatttgagccataaagatacatatagtgat

SEQ ID NO: 57 - DNA, 6795 bp, Glycine max
  misc_feature (1)..(6795): Glyma.06g202500.1
ttcgctcaagtccaagacataagcataacccggaccttgaaaccggcaacttgagttgaatcacagcgcagtatcacgtctccaccgatcatcatcttcttcgttcttctttcgaggagcgaccggttctgatcaaggagtttcaggttatcgtcgaaaatgttgtttcagattcctcgcctcaccaactctctcagagatcccttcgacgtggaccagtactatcttcatcgcaaaaccattctccacaaccaaaaacctagcaattccgcaagttcactcgatgaatcggaactggcgcggaagattgtgcacgggtgggaaaaagcttcgtcggacgtgcggcaggcctacaagcagtttataggagcggtggtggacttggttgacggagaaacgcgctccgaggagttccacgaggtggcgctgactatgtaccggctatttggcaggccaatggaggaggaggatcacattgataaaattatttcagataaaaagttagaattacaaaaacttgttggacgcacagttactgatgccaagttgaggcaagttgcatctctagcacagcgacttttaaatttgcagccgagcaataaaaactctgccatttcttttgaaagaaatctagatgctaacgaggatttagaatttggagctgatttgttttttcaagcaccagctcgtttcttggttgatgtatccttagatgatggggatatgatggattttgaaagcactgtttcattagaatttcacaaagaacagtatggccataatgtcccaacagatcattctgttgttaacagggaaaagttcaacctgacttggttacgagatgcatgtgataaaatagttaagaattgtaattcacaattatcccaagatgaattggcaatggccatttgtcgggttctttattccgaaaagcctggtgaagagatagctggagatctgttggatcttgttggcgatagtgcatttgaaactgtgcaaatttttttattgcatcgaaaggagattgttgattctattcatcatggcttattggtattgaagtctgataaaaatgcttcaaatgctcagtctcgcatgcctagttatggaacacaggtgactgttcaaacagaatcagaaaagcaaattgacaagcttcgacgcaaggaggaaaaacgaaatagacggggagtagaacatgctggtgatggtgaattgtctgcactggatttctcatctttacatcaagcaagtgagaggaaaaaaatgtttgatgagatgattggttctggagataagttcgagtcaatagctgttactgctcttcctgaaggaactgtaaggaagcattttaaggggtatgaagaggttaatattcccccaaaaccaactgcaccattgaaacctggagaaaagctgattgaaatcagggagttagatgactttgcacaagctgcgttccgtgggtacaaatcacttaatcgcattcagagcaggatttttccaactgtttatggaactaatgagaatattttagtgtgtgctcccacaggagcgggcaaaactaacatagctatggtttccattttacacgagattggacaacactttagggatggctacttgcataaagaagaatttaagatagtttatgttgctccaatgaaggctttggctgcagaagttacatcaacattcagccaacgtttatctcctttgaatatgattgtccgagagcttactggagatatgcagctctctaaaaatgaacttgaagaaactcagatgatagtgacaacacctgagaaatgggatgtcattacacgcaagagcagtgacatgtcactgtcaatgctggtaaagctcttaattattgatgaagtccatctactcaatgatgatagaggtcctgtgatagaggctctagttgccaggaccctacggcaggtggaatctactcagacaatgatacgcattgtgggcctttctgccactcttcccaattacttggaggttgcacaatttctcagggtaaatccagacacgggtctgttcttctttgattctagttatcgtcctgtgcctcttgcacaacagtatattggaattagtgagccaaactttgcagctcgtaatgaattgttgaatgatatatgctatacaaagattgctgattctcttaggcaaggccatcaggcaatggtgtttgtccattcacgaaaggacactgcaaagacagctgataaactggttgaactagcacgaaggaatgaggattttgaactttttagtaataatacacatccacaatataccttcatgaagaaagaagtcattaaatccagaaacaaagatcttgtgcaactttttgaatatggtgtgggtgtacatcatgctgggatgctacgtgcagatagaggacttactgagcgacttttctccgatggacttctgaaggttcttgtctgtacagcaactttggcatggggtgtcaatctacctgcacacacagttgtcattaagggtacccaattatatgatccaaaagctggtgggtggcgagacctgggtatgcttgacgttatgcagatatttgggcgagctggaagacctcagtttgacaaaagcggtgaaggtatcataattacatctcatgacaaactagcatattatctgcgactgctgacaagccaactccctatagaaagccagtttattagctccttgaaagataatttaaatgcagaggtggcattgggtactgtaactaatgttaaggaagcctgtgcatggcttggctatacatatcttttcataaggatgaggatgaatcctttagcatacggtattgggtgggatgaggtgatggtggatcctgctttgagttctaagcaaagatctcttgtaattgatgctgcacgtgcacttgataaagcaaaaatgatgcggtttgatgagaaaagtggcaatttttattgtactgagcttggtcgcattgcgagccatttttacattcaatattccagtgttgaaacgtacaatgaaatgttgagacgccacatgaatgacagtgaggtgattaacatgattgcacattcatctgaatttgagaatattgctgttcgggaagaagaacagaatgagctagagatgttggcacgcacatcatgtccattagaaattaagggtggtccttccaataaacatggaaagatttccattttgattcagttgtacatatctcgaggttctatagattctttttctttagtatctgatgcttcatatataagtgcaagcttggctagaataacacgggctttatttgagatttgcttacgaagaggctggtgtgagatgtctttgttcatgttggaatattgcaaagctgtggatcgccaagtttggccgcatcaacatcctcttagacaatttgacaaggacctttctgcagaaatattgcggaagcttgaagaacgtggggctgacctagaccgcttgtatgagatggaggaaaaagacattggggcattaattcgttatgcgcctggaggaaggttggtcaagcaacacctagggtattttccatcacttcagttatcagcaactgtgagtccaattaccagaactgtgttgaaggttgatctggtcattacgcctgttttcatttggaaagatcgttttcatggtactgctcaacgttggtggattttggtagaggattctgagaatgaccacatctaccactctgaactctttacgctgacaaagcgaatggctaggggtgaaccttacaagctttccttcaccgtaccaatatttgaaccacatccaccacaatattacattcatgctatttctgattcttggcttcatgccgaggcattctacactattacttttcacaatttaccattgccagaggctcgtactgctcacacagaactccttgatttaaaaccgcttcccatgtcttcccttggcaacagtacttatgaagcattatataaattttcacattttaatcctatacaaacacagacttttcatgtcctgtatcacacggacaataatgttctgttaggagctccaactggaagtggaaaaactatatctgctgagcttgccatgcttcgtctttttaatactcagcctgatatgaaggttatttatatagctcctttgaaagctattgtcagggaaagaatgagtgattggcaaaagcgtcttgtctctcagctagggaaaaagatggttgaaatgactggagactatactcctgatttgacggctctcttgtcggccaatatcatcatatctactcctgaaaagtgggatggaataagtcgtaattggcatagccgtagctatgtcacaaaggttggacttatgatattggatgagattcacttattgggggctgatcgtggacccattcttgaggttattgtttctaggatgagatacatatcatcccaaacagaacgtgcagtacggtttgtaggtctttctacagctctggctaatgctggtgatctagctgattggttaggcgttgaggaaattggactcttcaatttcaagccaagtgtgaggcctgtacccctggaagttcatattcagggttatcctggaaaatattactgcccaaggatgaatagcatgaataaaccagcatatgctgcaatatgcacacattcacctgcaaaaccagttcttatatttgtctcatcacgacgccagacaagacttactgcacttgacctaattcagtttgctgcatcagatgaacaatccagacaattccttaatttgccagaagaaaccctacagatggttctgtctcaagtctctgacctaaacctaaggcatactttacaatttggcattggattacatcatgcaggcctgaatgacaaagacagatctctggttgaggaactttttgcaaacaacaaaattcagatattggtttgtaccagcacattggcttggggtgtgaatcttccagctcatctagtgattatcaaggggacagaatactatgatggaaaagcaaagaggtatgttgattttccaatcactgatattttgcaaatgatgggtcgtgctggacggcctcaatttgatcaacatgggaaagctgtgattcttgttcatgaacccaagaagagcttctataaaaagttcttgtatgaacccttcccggttgagagtagtttgagagagcagttgcatgatcacattaatgccgaaattatttctggaaccatttgccataaacaagatgcagtccattatcttacatggacttacttatttcgtagactgatggttaatcctgcttactatggattggaggatgctgaatctgaatttctaaatacatatttgtccagcctagtacagaccacatttgaggatttggaagacagtggatgcataaagatggatgaagacaaggtggagcccatgatgttgggtacaattgcatctcagtattacctcagctacatgactgtatcaatgtttggttcaaacataggtccagatacatcacttgaagtctttttgcatattttatctgctgcttctgaatttgatgaactacctgtgcgtcataatgaggaaaaatacaatgaagcactgtctgagaaagttaaatatccagtggataagaaccgtctagatgaccctcacatcaaagcacttcttctatttcaggctcatttttctcaattggagttaccaattagtgactatgtcacagacttgaaatcagtattagatcagagtatacgcgtaattcaggccatgattgatatttgtgcaaacagtgggtggctttcaagctcaattacttgcatgcatcttctgcaaatggtcatgcagggtttgtggtttgacaaggaatcttccttatggatgctgccatgcatgaatacagatctgataagttcactaagcagaagaggaatttctagtgtacaggaattactagacattccaaaagcagcattgcagactgtaactgcaaatttcccagcttcaagattgtaccaggatcttcagcatttccctcatgttaaaatgaaattaaaagttcagaggaaggacactgatggtgacaggtctcgcatattatctgttagattagagaagaccaattctagacgacactcttctagagcatttgtacctcgatttccaaagataaaagaggaacaatggtggttggttcttggtaatacctctacgtctgagctatatgctttgaaaagagtttctgtttcagatcacttagttacctcaatgaagttgcctctgactccagctaatcttcagggcgtaaaactgattttagtctccgattgttacattggatttgaacaagaacactccattgaagaacttgatgtatgttaagtagtggagacaccattggtcagtgccattgtacatacaacgtaaacgtaagatttcttgaagagggttggggctgcccaggttgtaccaaaaaatgtttttttttaacttgagaaaaagtcaatatgtatatccataggatttgcaatctcttgcatttaattgttttataggtaatcataatgatcttgtttttagattttctttatttattttccaagtcgtgtcgccatttgtaagtataaaggtttacagtgcaaggattgaaagatgtctgaacatttataaattgtgaaggaatggatctccgcaagcataaaaaatccagcatttatatgcgagtaatacacgttatctaatggggtggtc

SEQ ID NO: 58 - DNA, 2974 bp, Glycine max
  misc_feature (1)..(2974): Glyma.17g215800.1
cctgcgtatcgtttgggcagaaggcgaaacagcgatcgacgagggaggaagggaaggacttgcaggcactggcgaagacgtcgacgacggcttcgagatcgggggaggaggggcagtggacgacgccgacgatggcgagggttttgcggtgcgactggaagtcctcccatggactcggcggcgcgccaccgaggacgaacttgaagcggagggagccggagtcccagggctggacggcgaagggggacttctggtgctcggtgtagaaggagctgatcgcggagagcgggatcgtgtgcagcgggagcagcatagagtagtagtcccgcagcacgttcgccggcaccgctccgattggaaccaccgccacctggatcatcgccgatccctcgatgctcacttccggctccatcgcggtcacggtggtggttcgttagttacttcctgtttcagaaaccaatctcactcgctcgctctactcgttcgttgctgtttttaccttaatcactgagatcttgaaaaatgcgaaaatgaccgaaatgtccctaacttgaacgttaaatgaccgttttgccctcaccttgttctttttggagattctcgtttcagcgccgtggttgtaccggtcgctgcatctacgacggcgagcaaggagaagaatgcacccaaagagcgtcgtcgaggggttgaggaattaaagagtgcagaagacagtgataggtcatagaatcacgttggaattgcggatcggagctccggtggattttgtggccgttgaagccagcaagggtggtgccgacacggtggttgccgttgtgcttccaattttttccggcaagggcacttgttagttccttcctcagattaaaaggtcaccggttcaggactcgccctcaactcggacaccaactcaaccaccttgtcctaatgtctgtggagagcgaaactgggtcgtttcgggactctgaaactcggaacaatcttcgaagaattcttgagtcatgctctaaattggcggaggctggagattttcatgaatctgaaaacacagcagtttcagagcttgtcgagttccttgattctttgttggatgctgccatgtctgacctggatagtgaaaatgcagagaatgatgcatttgaagctatctctgagatccatagatatatttgttctccttctattgaccaggaagttgttgatgccctttcctttgaactgccaaaggctgtttcaaagtttgtggggatttcaagtagatttttggacttggcaattagcatcattgatcagtttattgtgaaatgtggtccaagggatatgctctcaattctctgtaatacattaggttactcaagtaagatcatcaaggctgccagttacattgtccctcctttatcagggctctcaaaggtcttactttccattcagaggcgtcagtttgagcaagtaaaagtagccgttcctataattcttaatatattgaaggctgtgtctttggagtcagaagaagcagaacttgaggatgtatttgacacagctgttgagattgcaaattctatatatgaagtttgcaataagttggagagggacacaaaggagaagctccgagctcttcttggtctatatgtcatgcaatgcatggctcttgtttcagctagcataagctataaagcttccagttgtccttcttcggtattacaactgtcacaaatttcttcatattgtggtttatcatatctcagtctagtaacaacttatgatgtagagattgtggctgaatctgtgtttggaggagaagataaagatcactgtaccggttgtttttctcatgtcaaacatggtgctgctctttcagtggtttgggggcatgtctcaaaggaggttgctcaaactgctaaagaggatttgattgccatcagggatgaacttcgtaataaccaaacaaaaaggtggcaagcaataggaacattaaagcatgtactttactttgtaaatctaccatgggaattaaagaaacatgctatcgacttcttgcttagcatcacagatgaaggtgtctccagaaactacaacgaggaacgttctgaatggtcatcttatgtgccaagccttttctcggctttgcaggctgtaaaaatggttatcatgtatgccccagagccagaacttagaaaaaaatcctttactgtgctgaaaggagtacttgctgatattccaaattctcaaagatttgacattatgaaagcattgattacaaataccgactcttcctcgatgatcgccattttcatcgatcttgtcaggaaggaaatgcatacagcaatctgcagtagtagatcaatagtaaaagatgccccacagatagataacaaagcatttccggatacctccttttggaatcccgggatccttgagttggtggagttggttctaagacctccacagggcggacctccttcccttcctgagcagagtgatgcggtgttgtcagccctcaacctatacagatttgtattgatgacagaatctgcagaaaagacaaacatcactggagtgctgtcaaggaacaatttactgaaggcctacaatgaatggttgcttcctttgcgtaccttggtgacaggtataatggcagagagccatagtgattatgatgagtttgcagttgacactgtatgcaccctaaatccacttgagttggtgttgtatcggtgcattgaactcgtagacgagaagcttaagcaatccacataagctgccccattagcaaaaggttttttttaataaaagatggcaaatgttgtttttgaaatattgatcatctaaagcaaggttattgaattgcaatgcaaatagtgagtgaattgtccagccagtttttgaatggtgatttataaactgtattgaatagtatgattagagatacgatgaaaatagcttttcagatataaataacgtagtgtttaatata

SEQ ID NO: 59 - DNA, 3758 bp, Glycine max
  misc_feature (1)..(3758): Glyma.15g097000.1
cggctacaaacacagcaaccacctactttttcctcaaacttagaatcctctttcaatttctctctggaccaaaccctcgaatagttcgatttcaaaatccatggcgagaccttccaagctacactcatcttccgacgaagcgctctccaatgcttcgagttcctccgatgaagaggagcaagtcaacgagcagatcaacgaagaggaagacgaggaggagctcgaggcggtggcgcgccctgccagttctgctgacgacgacgacgaagtcgccggcgacaatccgccggactccgatgaagatccagccgccgatgacgctgacgatgaccaggatggggataatgttgatcccgaaattagcaagcgagagaaggcgagattaaaagaaatgcagaaaatgaagaaacagaagattcaggagatactggatgtacagaatgcggccattgacgctgacatgaacaatagagggaaggggcgtctgaagtatctcttgcagcagactgagctgtttgctcattttgcaaaaggggatcaatcttcgtctcagaagaagtcaaggggaaggggtcgccatgcatccaatttcaccgaggaagaagaagatgaagaatacctaaaaggagaagaagatggtctagcaaacacacgtctggtgacacaaccatcatgtatccaagggaaaatgagggattaccagctggctggactaaactggctcatacgattgtatgagaatggaataaatggaattctggctgatgaaatggggcttggtaaaacattgcaaactatatccttattaggttatttgcacgagttccgaggaatcaaaggtcctcatatggtggttgctccaaaatctactcttggaaattggatgaatgagattcggcgcttttgtcctgttcttcgtgcaatcaagtttcttggcaaccccgatgaaaggagacatatcagagatgaattgttggttgccgggaagtttgatgtttgtgtcacaagttttgaaatggcaatcaaggagaagtctgctttgcgtcgatttagttggcgctacataattattgatgaagctcatcgaatcaagaatgagaattccttgctgtccaaaacaatgaggctctacagtacaaactaccgtctccttattactggcacgccacttcagaataaccttcatgaactctggtctcttctcaactttcttctgcccgaaatttttagttctgctgaaacttttgatgaatggtttcaaatctctggtgaaaatgatcaacaggaggttgttcaacaattacacaaggtcctccgaccatttctccttcgaaggttgaagtcagatgttgagaaaggattgccaccaaaaaaggaaactattcttaaagtaggcatgtcccaaatgcagaaacagtattatagagccctacttcagaaggatcttgaggttgtaaacgctggtggtgaacggaagcgcctcctgaacatagctatgcaactccgcaaatgttgtaatcatccatatcttttccaaggtgctgaacctggtcctcccttcactacaggagatcatcttattgaaaacgctggtaaaatggttcttttggataagttacttcctaaattgaaagagcgcgattctagggtccttatattttcacagatgactaggctgctagacatactcgaagattatttaatgtttcgtggatatcaatattgtcgcattgatggaaatactggtggggatgatcgagatgcttccattgatgctttcaacaaaccaggaagtgagaaatttgtcttcttgttatcaactcgtgctggaggtcttggtattaatcttgctactgctgatgttgtcattctgtacgatagtgactggaacccacaagttgacttgcaggctcaggatcgtgctcataggattggtcaaaagaaagaagttcaagttttccgattttgtactgagtatacaatagaagagaaagtcattgaaagggcctacaaaaagcttgcacttgatgctctggtgattcagcaagggcgattggctgagcagaagacggtaaataaagatgaattgcttcaaatggttagatttggggctgaaatggttttcagttccaaggatagtacaattacagatgaagatattgatagaattattgctaaaggagaggaggcaactgctgagctagatgccaagatgaagaaatttactgaagatgccatcaaatttaagatggatgacactgccgagttatatgattttgatgatgagaaggatgaaagcagatttgatataaaaaaaattgtgagtgagaactggattgaaccacccaaaagggagcggaagcgcaattactcagagtctgaatacttcaagcaaacaatgcgccaaggtggtcctaccaaaccaaaagagccccgtattcctaggatgccccagttgcatgatttccaatttttcaacacacaaaggttgagtgagctgtatgaaaaggaagtacgctatctcatgcaaacacaccagaggaatcagataaaggattcaatagatgttgatgaaccagaagaggtgggagatccattgacagctgaagagttggaagaaaaggagcgcttgctagaagagggattttcttcatggagccggagggattttaatactttcattagggcctgcgaaaaatatggccgaaatgatatacaaagtattgcttctgagatggaaggaaaaaccgaggaggaagttgaaagatatgcaaaggtctttaaagaaagatacaaggaattaaatgattatgacagaattattaaaaacattgaaaggggggaggcaagaatttctcggaaagatgagatcatgaaagctattggaaagaagttggaccgctacaagaatccgtggctagagttgaagatacagtatgggcaaaacaaagggaagttgtacaatgaagaatgtgacagattcatgatatgcatggtgcacaaacttggctatgggaactgggatgagttaaaggcagcatttcgaacatcacccttgtttcgatttgattggtttgtcaaatctcgcaccactcaagaactggctaggaggtgtgacaccctcattcgactggtagaaaaggaaaaccaagaatatgatgagagggagagacaagctcgcaaagagaagaaacttgccaaaagcatgaccccatcgaagcgtgctttggcaagacagacagagagtccatcttctttgaagaagcgcaagcagttaaccatggacgattatgcaagcacggggaagagaagaaaataatgaacatatgctctatattgcgtaggataagtaaggggttgttgggttttaaagtccttggtgatttggatgtggcccagacttggcaattgatggccaggcttgccttccaaaagccgtgctagtttgctaacaacctctaacttgtgtaggctccaaatatctgttgtatggctagttagagaatatcaagtagaaatgggttgttgtattgtaagtatgtatatctacaaaacaaatccttagatttgaacgactagttcaatgaaatatatgtagttctaacttaatgctattttgaagtagacatgcattaagctaacgtttggaaattccggttggccattgaattcgcaagtggaaagcttcaatttgatgccaaaatgatgttttctacttttatgaaattatatgattatacaattaaaattctagagag

SEQ ID NO: 60 - DNA, 1053 bp, Glycine max
  misc_feature (1)..(1053): Glyma.11g188900.1
ctgattctcacgggctcacggcctgtaaccctcgaaacgcgaatggccgtgtcggccacctaattctctgtttaacgtcttcaatccttcttccattgatcactatttcgcagtgtttgccttagtctcttgaggtgcaatgagattggagaagtgttggttctgttcttctaccacataccctggacatggaatccagtttgttcgtaacgatgccaagatttttcggttttgtagatctaaatgccacaaaaacttcaaaatgaagaggaaccctcggaaagtaaaatggacaaaggcatatagacgagtgcatggaaaggatatgacacaggactcaacctttgagtttgagagaaagcgaaacaggccagagagatatgacaggaatcttgctgagaatgtcctcaaggccattccaaagattgataaaatccgagtcgccagggaggagaaacaccataagaataggatgaaaggcaagaaacagaagctgcatatggaggcagttagggagttggaacagggcatcagtctggtcaaagctccatctgtgcttcaaaaggacccttttctcactttacccaagatcaaagttggggtttcccaacaacaacaatcagaggagaatcatcccatggaagagtgatgtcatgccaatgctgcactttcaaccccagttttgtgattatgtgtttcatatgtggattcagtgtccaaattacaatttggttcattgctgatccgacatgtgaatgatgcgattttgaaacaaaagttttggccgttgagaatatgttagtgatattgtttttggacaataataatactgtgtgatactgcactattatataaagcaaagcagaaagacgttgtccaacatgaagtctccttggacctattgtacctgtcactgtcaggagtattcaatctgttaatatcaagtcaaatgttaaattagtaggaaagtaaaagttctttatactaggtacttcagtcaagaacaaatttgactgttgaacgtctatttaggtagtgtttggttaaggaaaa

SEQ ID NO: 61 - DNA, 1093 bp, Glycine max
  misc_feature (1)..(1093): Glyma.08g209300.1
taatacttcaatctcaagcataatgcggtgtacgctctcatggaccttcgccacacccaataatttccccatcctcaactcactatgagtttctgtgaagcaaaagcaaaacctatcgcagcacgctctatcatctctctcagtaatggcaaccacattcacgtttttccgaccaaccatgatccgggcctccgctggttctccgggcaggcccgacccgagcaacaggaagcccgtttcctccaattggtgggctccgctgttcggatggcccgcggatccggactacatcggcccatcgcagaagacgagttatcaatcggatccggagcgggaagtgggcccgggccggcccagatccaaattcgcagcggggtgcttcacggagaagaaggcaaaagagctgcggaagaagaccgtggaaacgtcgacgtttcacgacatcatgtaccactccgctattgcgtccaggctcgcgtccgatgtttctaaagggtacgagaaataaatgtttgttttctaattaatgttttctaccctcagactcactcatcgttgaatttcgttttaatttctttcaactatgaactaatggcctattcatgatttgggacacactgtaattaacctatgtgcgtgatttgtctccttatgttctattagtgtggttctctcttcctttttttttttctctttaatttctaattttggttttaccttctttaatcttacaccaaggtgaagtggaagacggattttataatacaaaaaattaattgtgcagtcaaatgtattttctttgtatggtaaggctttcaatggtttctccttttatagcatgcacttcaaattcagatcaatgagatatgctaaaaatgcaacatcttgacaagatgctgcaatttggaatagtagtttttatatttcagttttattttggacagccttttaattttccaagtaactttatgtctcgattaattaattcatatcaaatagaatagatctatgtaggaaaaggaagctcactctaacctgcttttatcaggggttggttaatttactctaagtaaaaacagggttaagtctatga

SEQ ID NO: 62 - DNA, 1403 bp, Glycine max
  misc_feature (1)..(1403): Glyma.16g092500.1
acaaaagtgatctatcctttgtatttttatttgtcactaagccctcaaccctcatttctctcgccgtcgcccatcttgacatcttcgctctccttaccttttcgagtctccggtacctcatttgtctcgccgtagtgcgatctcggtccagtctctggcatacacagcaagataaaatcaccagatatttgcgttaaaagcatcagggtttgcgatgataatgaagcgctgatatttgcctccaaatcactctcactcagctaaatttatcacgtgctagaaagaaagatcaatccgactatgaataaaatgtatatgaaattcccagttcttatggcaatggatgacctatacctttatgtaccaaatttctaaggcactgaaatttccaaaacaaatagttgttgatgatttgtcgacatgaagaagttgttagattttgggaggaaagcccttttttatgtcagggtgctttctggatatgaagagcgaagaatacgatcttataggctgcagcttgagcaacgcgtacaacaggtacaagcaaggaaagcggccataaataaagtacctgagcagattattttatccgaggttcggcgaatggttgatgagatgaaagctttgaataagaagctggaagaaacagagacagccattgaagactatttcaagcctctagacaaggaagctgagattataatgaaaatgcaaatacaaggggaagagagaacttcagagattatgatgcaggcactggagaaacaagctacgcttcaacaagctgaagctgaaaaaaatgctagtaagcatcaagttaaccatgctgaaaccaatatgaatgaatctgagatgatggaagaagagaaaactttgacggagatgttgaaagcactgcaacaagaagttttgcttgagaaagctgatactgaaagtgatgttaatgcgcatcaagcagacaattctcctatcaacttgagctcagcatctacaaccacttctaaatgaagttgagattattttgaaacattggtgattcctgatttttattgtctagctatgaattgcatttcagcttgcctcctgaaatgtcaatcatccttggcgaattcaactaaccaaggcaggactagggcatatttgtagtttatttgttttactaattttattcaacaatgttttcatcttttttaggaatgatcaaaattatcagttttttcatgagatatggttaattaataaactttaaaatgaacacaacttaggaaaaatatgtttatgctagtctgcacatcttcaatcatcttagcagagggtgcattctgtcaattaatgtagataaatattgaggaaaagtgagagttagagtcagagagacctattattagtgctgatttcatagt

SEQ ID NO: 63 - DNA, 12325 bp, Glycine max
  misc_feature (1)..(12325): Glyma.10g030000.1
tcaaccaaatgtcaaaagaagcatatctaaaagaaggtatgatgatgaaattgaattcaaccccataaagcagaccaaaccgcatgaagaagacggtggagagagggagaatgggagcgaggaggctttcacgtattgcccttcaatcacggcgttccacgtggacccttcccattcgtggaccccacgatgacgtggtcgaggtgtgtgtgcgcgaaaactgaaaactcacagattagactatatatcaccgaaacacacagagcaagagagagaagagtgaagagagaagaaagacttgtttattgatccaacaaagccgtccaaaagaggcacacaaacgcagaaatagagaaacgcgattttcaaattattattattattttttccgactttgcattttgcaacctaagctcgcatttatttttcttttttttttttcctcttcaaagcactcatcgttttgttcttgttgtttcattagctgcctccgctttctagggctgcaaaccaccgaaacattttccgaaaaattagacaaagctagattgatcgaactaaattcaaataaaaaaataaaaaaaaataaggaaaagttcggaaacgcggagaagaagaactgaattgacaaatccaaaacctacgaatcgcaatccggtagatcttggtgccatttttgatcgcatttgcttgctgcagctggtggaattgcagattgttttgttttgtttcttctctcgtttcgttgattggtttttgaatggtgttttggtttttcccttttcggagggaaatcggcaagaggtagttggtggtggatctggtgaatgttcatcggatgagagagaggtgttcatatgtttcaaggatcgaaagggaaaaaaacgatgaaatgggttacattgcttaaggacttcaaagagaaggttggcctcactcaatcgccaccctctgcttctgctcctccttcttctttttctcctccttcctcttcttcccgcgacaacaacaatgcctttccagcttcgcaatcctctgcttcgtcccctaccagggacaaacatgaactggaattggacttcaagaaattctgggaagagtttcggtcatccagctctgagaaggcaaaagaagcggccttgaatttgagtatagatgccttttgtagattagtgaagcagcatgctaatgtagctcagttagttaccatgttagttgaaacccatatattctcttttgttgtcggaagagcatttgtaacagatatagaaaagttaaaaatcagcagcaaaacaagatctttggatgttgctcaagttttaaagtttttctcggaagtcacaaaggatggaatcagtccaggagcaaatttattaacttcagtggaaatccttgtctctgggcctattgacaagcaatctctacttgactctgggatattttgctgtctcattcaagttctcaatgcccttctcgatcctgatgtaaccattcaaaggccaaatagtactactgatcatgaagataacattgtattacaaaaagattatgatgaagttgggcaaaaccgccggcttgaggtggagggaagtgttgtgcatatcatgaaagctctagcaagccattcatcagcagcacagagtttgatagaggatgattcacttcagttgctttttcaaatggttgccaagggatctttgattgttttctctcgttataaggaaggacttgttccattgcacagcatacaacttcacagacatgctatgcagatacttggtcttcttttggtaaatgacaatggaagcacagccaaatacatccgcaagcatcatttgataaaagttcttctattgtctgtgaaagattttgatcctgattgtggagatgctgcctttaccgtaggcattgttgacttgttactcaagtgtgtagaattgtcatatagagctgaagcggctagtgtgagacttcgagaagatatacataatgcccatggatatcaattccttgttcaatttgcactaactctgtccaatatgtcaaaaaatcagggctttcaatctacacgttctgatacatttgatgaccaagatattgcttctgatggatccgaaaatagcagaggacaaaattccaatgagcaagaacattcctccattcagtatctttcacccacattatctaggttgctagatgttcttgttagtctagctcaaactggaccaaatgagtctccacgtacttatggaggtaagggttctaaatctactcagaacaagggtggtggtcatagcaaaagtcgtaccttatcttctgattggcttggtgatgaattatgggagaaggaaaatgataaaattaaagaccttgaagcagtccagatgttacaagatattctcatcaaagctaatagctggaagttgcaggctgaagtattaaatagactgtttaaaattttttcaggccacatagagaattataggctgtgtcagcaattacgaactgttccacttttaatcctaaatatggctggttttccttctcatttgcaagagataatcttgaaaattcttgagtatgctgtgactgttgtaaattgtgttcctgagcaagaactactttcactttgctgtttgttgcagcaaccaataacatcagcattgaagcagacgattctttctttctttgtaaaacttttgtcctttgaccaacagtacaagaaagttctacgagaagttggtgttttggaagttatgttagatgatctgaaacaacacaggattttgggtccggatcaactgactgttaactcggaccagttggagaggaaaaatagctcaaacaatttcaagaaacgcctggacaatagggatgttattattacttcacccaagcttatggaatctggttcagggaagttccctatttttgatgttgaagatacaattgctattgcctgggactgcatggtatctttattgaagaaagctgaggttaatcaagcttcattccgctcagctagtggtgtgactgtgatgttgccttttctggtgtctgatgtacatcgttcaggggtccttaggatactatcatgtcttataattgaagatacctcacaggctcatcctgaagaattaggtgtggtggttgaaattttgaaaagtggaatggttaccagtgcttcaggatcccaataccggcttacccttgatgcaaaatgtgacactatgggagcactgtggcggatcctgggagttaataattctgcgcagaaggtttttggtgaagccactggtttttctcttttacttacaacactccatggcttccaaagtgatggtgggaactcggatcaatctttattgaatgcttatattaaggtgtttacgtacttgttgcgtgttgtaactgctggagtatctgacaatgctgttaatagaatgaagttgcatgcaattatatcatcacaaactttctttgatcttcttagcgagtctggcttattgtgtgcggatcatgaaaaacaagtcatccagttgatgttggaacttgcccttgaaatagtgattccgcctttcttagcatctgagggtttgacaaaatcaaatgcaattgagaatgagtcatctcataatcttttattggctccatcaggtccaattaatcctgataaagagcgggtttacaatgctggtgctattagagtactgatccgttcattattgctttttactcctatggtgcagttaaaacttttagacttgattgaaaagttggcccgtgctggtccctttaatcaggaaagcctcacgtctgtaggttgtgtggaacttttgctggaaacaatccacccttttcttctgggttcatcttcgttactctcttatgcattgaaaattgtggaggtccttggttcttacaggctatctgcatctgaacttcgtatgctcattagatatgttctgcaaatgaggatgaaaaattcaggtcatataattgttgaaatgatggaaaaattaattctgatgggagatatggccttagaaaatatttctctggcaccatttgtggagatggatatgagtaagattgggcatgctggcattcaggtttccttgggtgaaagatcatggcctcccgcggctggttattcatttgtttgttggttccagctccgtaattttttaaaatcacaatcaaaagacactgacgcttcaaaatttgcctcttccaagaagcgctctggttcaagtggattgcatgagcgacatatcttaagaattttttctgttggtgctactaacaatgataatgcaacctatgcagaactttatctccaagaggatggtgttctaacccttgcaaccagcaactcttcctccttatcattttctggtgtagaacttgaagaaggaaggtggcatcaccttgcagtcattcacagcaaaccaaatgctcttgctgggctgttccaagctagttttgcatatgtttatctaaatggaaagctaagacacactgggaaattaggatattcaccatgcccacctggtaaacaattgcaggtcactattgggacatcagttggaaatgctagagttagtgatttgacgtggaaactacgctcttgctatctttttgaggaagtgctttcaccaggctgtatttgttttatgtacatacttggtagaggatacagggggctcttccaggacacagaccttctgcaatttgtacctaaccaggcctgtggtggtggtagtatggccatattagattctttagatgctgatctgactttgtctgctaatggtccgagactggatgctacaagcaagcagggagatctaaaagcagatgggagtggaattgtctgggatttggagagacttggaaacctttctttacagctttcaggaaagaaacttatttttgcatttgatggaacttctacagaatttattcaatcgtcaggtagcttttcaatgcttaatctggttgatcctatgtcggctgctgcctctcctattggaggtattccacgttttggacgtctctgtggagatatttatatctgtaagcaaggtgtgattggagagactatccgccctattggtgggttggaacttgtacttgctcttgttgaagcagcagaaactagggatatgctgcatatggcccttactctacttgcctgtgcgcttcatcaaaatcctcagaatcttaaggacatgcaaatttataggggctaccatctgcttgcgctttttctgcgtcgtagaatgtcattatttgatatgcaatctcttgagatcttctttcagattgctgcttgtgaagcttctttttctgaaccgaagaagttggagagtagccagactactttatctccttcttcatctctgctggaaaccagtcttgaggatcattttttgtcaaagtttcacgatgagaattcttcacttggatctcatggggacatggatgatttttctgtacaaaaagattcatttagtcacatttcagagctggaaaatactgatgttgctgctgaaacttcaaattgcattgtcttgtcaaatgcagacatggttgaacatgtcttattggattggacattgtgggtaactgccccagtttcaatccaaattgcattacttggattccttgaaaatttagtgtccatgcattggtacagaaatcataatcttacaattttgcgtcgaattaaccttgttcaacatttactagtgaccttgcaaaggggtgatgttgaagttcctgtcctagaaaagttggttgtactgcttggggtcattttggaagatgggtttctatcttcggagcttgagaatgtggttagatttgtgattatgacatttgatcccccggggttggttccacagcgtccaattatgagagaatcaatgggtaaacatgtaattgtcagaaatatgttgctagagatgtttattgatctacaagtcactattaaatcagaagagttgcttgagctgtggcacaaagttgtctcctctaagttaattacatattttcttgatgaagcagttcatcccacaagtatgagatgggtcatgactctacttggtgtgtgtcttacttcttctccaacgtttgcacttaaatttcgcaccggtggaggttatctaggtttagttcgggtgctacccagtttctatgattccccagacatctattatattttattttgtttgatatttggcaagccagtttacccaaggttacctgaggtccgcatgttggactttcatgcccttatgccaagtgatgggagttatacagaactgaagtttgtagagttgttggattctgtaattgccatggcaaaaactacttttgatagaataagcatgcaggcaatgcttgcccaccaaaccggtaatctttcccaggttggggcaagcctcgtggctgagcttgtagagggaaattcagatatggctggtgagcttcagggggaagctctgatgcacaagacatatgctgctcgccttatgggtggagaggcatcagcccctgctgctgcaacttcagttctaagatttatggttgatttggctaagatgtgtcccacttttactgctgtttgtagacgtgcagaatttcttgaaagctgcattgacctatatttttcttgtgtgagggctgcacatgctgttaaaatggctaaagatctctccgcagttacggaagagaaaaccttgaatgattgtgaagatacatgcagttcccaaaatacattttctagcttgcctctggatcaggaccagtctgtcaaaacctctatcagtgttggaagctttcctcaagggcaggtaagtacaagttctgatgatatggctgcaccaccgaactctatggctggtgagagacctcagaataatcttagtgtatctgagctggagtcaaataaatctgtccgcgaagatatacaaactgttcagagcttggatggtgataatgctgatcaaggttctgttgcttccagtgcacatgaattcagctttcacagtatcaaaggcaatttggacattctcccaccaacagattcccagagttcagcatcttttgctgcactggattctcctgtattttcagaaaagtccagttctatagttccccttacacattcttcgtcccctgttgttgcattagcatcttggctgggaagtgcaaaccataatgaagcaaaatctcccttaactgccactccttcttttgattcttccatgtctgctgcggagtttgatacatcttcaaatctaaagtctagttctcaagggccatcttctacaaatgcttacttcactgtaacctcaaagctgcttttggacgtagatgattctggatatggcggtggtccatgttctgctggagctactgccatgttagatttcattgcagaagtcctttctgattttgtgacggagcaggttaaagcatcacagctcgtagagaacatcttggaaagtgttcatctatatgttgatggtgagtctgtgttagttttccaaggtctatgcctcagtagatttataaacttccttgaaagacgactgctacgtgatgatgaagaagatgagaaaaaattggataagattcgctggtccacaaatttggatgctttgtgttggatgatagtggatcgggtatacatgggtgcttttcctcagccttcaggggtactgaaaactcttgagttcttgttatcaatgttgcaattggcaaacaaagatggtagaattgaagaagctgctcctggtggaaagaggctcttatcaatttcaagaggaaataagcagctagaggcttatatccattcgattcttaaaaacactaatcgaatgatattatattgcttcctcccatcattcttagtcagtataggggaagatgatcttcttttgcggttgggtttgcttaatgaacctataaagaaattgtcctctacttcctctcaagatgattcaggaattgacataagtacagtcttgcaattattggttgctcatagaagaattatattctgtcccagcaacatcgatacagatcttaattgctgtctatgtgtgaatttgatatctcttctctgtgataaaagacaaaatgtacaaaatattaccattgatgtgttcaagtatcttctggtacataggagagctgcattggaagacttgcttgtttctagacctaatcaagggcagcaacttgatgtgctccatggtggttttgataaattattgactagaagtttatctgagttttttgaatggtatcaaaatattgaacaggttgtgaataaggtattggagcagtgtgctggcattatgtgggtgcagtatattgcaggatcagcaaagtttccaggagtaagaatcaaaggcatggaaggtcgtcggaagaaagaaatgggacggaaatctcgagaagctgcaaaattggatttaagacactgggagcaggtaaatgagcgaagatatgcactggatttagttcgtgatgcaatgtccactgagttgagagttgttaggcaagataagtatggatggattctacatgctgagagtgagtggcaatgtcatctacagcaacttgtgcatgaacgagggatattcccactaagtaaatcctctttcacagaagagcctgaatggcaactttgtcccattgaaggtccgtatcgaatgcggaaaaaacttgaatgctgcaaacttaaaattgataccatacaaaatattcttgatggacattttgaattagagaaaccagagttgtctaaagtaaaatttgaaaatggtcctgattcatcagagtcaaaaccttattttcaacttttgactgatggtggcaagcagaatggttcggatggcgagccctttgatgaacctttctttgaaaagttggatagcgtcaaagatgctttttctgctaagaatgagtggaatgatgacaaggcaagtagcataaatgaagcaagtctccattctgcacttgaacttggtgccaagtctagtgcagtatctgtcccaatagaagaaagcacacacggaagatctgaaatgggatccccaaggcaatcttcttcattgaaaattgatgatgttaagattgctgatgataaatctgataaagaactgcatgacaatggtgaatacttgatcagaccttttctggaaccatttgagaaaatacgatttaaatacaactgtgaaagagttataagtcttgacaaacatgatggcatattcctgataggtgaattctctttgtatgtgattgaaaacttctatattgatgattctggttgcttttgtgagaaggaatgtgaagatgagctttcagttattgatcaggctttgggtgttaagaaagattttactggcagtgtggattttcaatccaaatcaactttgtcatggagcacaccagctaaatcattggttgggggaagggcgtgggcctatagtggtggtgcatggggtaaggagaaagtacatagcattggaaacttacctcatccttggcgcatgtggaagcttgatagtgttcatgagattttgaagcgtgattatcagcttcgtcctgttgctgttgaaatatttagcatggatggatgtaatgatctcttggttttccacaaaaaagagagagaagaagtttttaaaaatctagttgccataaatcttcctcggaatagcatgctggacacaactatttcaggatcatcaaaacaagaaagcaatgagggtagccgtcttttcaagataatggcaaaatccttttcaaaaagatggcagaatggagaaataagcaatttccagtacctcatgcatctaaacaccttggcaggacgtggatatagtgatctcacccaatatcctttctttccatgggtccttgcagattatgagagtgaaaatcttgatttgtccaacccaaaaacatttcgtaggcttgataaaccaatgggttgccagactcctgaaggtgaagatgagtttagaaaaagatatgagagctgggatgatccggaggtcccaaagtttcactatggatctcattattctagtgctggaattgtcctattctatcttctccgcctacccccattcagtacagagaatcaaaaacttcagggtggccagtttgaccatgctgatcgccttttcaatagcataaaggatacttggcttagtgctgctgggaagggaaacacatctgatgtgaaggaattgattccagaatttttctacatgcccgagttcttggagaatcaattcaatcttgacttgggagagaaacagtctggcgagaaggttggggatgttgtcctacctctatgggccaaaggtagtgctcgagagttcatcagtaagcatagggaagctcttgaatcagattatgtctcagaaaatttgcatcactggatagacctcatttttggatataagcaaagagggaaggctgctgaggaatcagttaatgtgttctatcattatacatatgaagggagtgtagacatagactcggttacagatcctgcaatgaaagcatccattttagcacaaattaatcattttgggcagacacctaaacaactattcctcaagccccatgtgaaaagacgaactgacagaaaacttcctccccatccccttaagcattccagtcatcttgctgcacatgagattcgcaaaagttcttcacctatcactcaaattgtcactcttaatgataaaattctcatagctggaactaacaatttgctaaaaccaagaacatataccaaatatgtggcttggggttttcctgatcatagcttgagatttattagctacgaacaagataaacttctttcaacacatgaaaatttacatggaggcaatcaaattcagtgcgctagtgttagtcatgatggtcatattctggttacaggggctgatgatgggctagttaatgtatggagagttagcaagtttgggccccgtgccttacgtcgcttgaagttggagaagccactttgtggtcacacaggcaaaattacatgccttcaggttagccagccttacatgcttattgtgagtggatcagatgattgcacggtcattatatgggatctcagctccatggcatttgtacggcagctcccagaatttccagcaccagtttcagcaatttatgttaatgacttgaccggagagattgttacagcagctggtattcttctggctgtttggagtataaatggggattgcctggcaatgatcaaagcatcacaactgccatcagattccattctctctgtgacaagcagtacgttttctgattggttggacacaaagtggtatgcaacaggtcatcagagtggagctgtcaaggtgtggcagatgattcactgctccaacccagatagctcccttagcaaatcaggttttggtgggtcgggaggtttaaatcttggtggattagaaccagaatacaagttggtcctacgcaaagtgctaaagtttcataagcattcggttactgcccttcacctcacaactgacctgaaacagttattgagtggggattcaggcgggcatttgctttcctggacactgcctgaagagagtctgcgaggttcattaaatcaggggtgagactggtaaaagatggttcgttctgctgacttcagcttttggccagcctttaatttgttgaatcctaacattggcttgagtggatctcaattgttgaaagatggattcatgttcataattcgagagaattgcaaaagaatgctggccagattgaaacagagcaagcaaggttgcaaaagaaaagatgatatcacagcgtatagagggctatgaaactatatgcgtgtaagagtacaatatattcactaggtgggtgaagaagcatctgtcaagtaagatggattttaggtggaagaggagaaagcaaatgttgcccgcggttttgtattttgggtgactggcggagaatattttgattttgccagagaagtctactgttttttctttgatgtaaatatgtgattttagtgtgtaattaaggtgtatagtaaaagggtagtcatgaaatggattgtgattgcaatgataggcccaatgtgaggtatgatcgtggcattagtgcaatcctttatcgggaattctttttacatgttgacattggggcatttcttttattgagcccctgaaagaaaacaaggacactaagaaggtcattgcctgtgatttgtacatttttttaaaaaaaaaatattcctccc

SEQ ID NO: 64 - DNA, 1537 bp, Glycine max
  misc_feature (1)..(1537): Glyma.19g242300.1
aacaaaatacgcaaagcagaccaaagaccaaaagaacaagacaaaacaaaaaaaaaaaacaaaaaagacgtgacagattaaaatcccattgctccatttgctattcggaaatatcagaatcagaccatccaaacgaagcagaaagagctcatagaagttctcgtcctcttctctctatcttgaatcttcttctcttatcagaaacgcgcgttgctcggataaggttgtgctgcgccgactcactggtactttgcttaatatggcggctgagaagtcaaacattgcaaaagatgtgactgaattaattggcaaaactccattggtatatctcaaccacatcgtggatggttgtgttgccaaagttgctgccaagcttgaaatgatggaaccttgctccagtgtcaaagacaggataggatatagcatgattgtagacgctgaggagaaaggactcatcacaccgggtgaaagtgtcctcattgaacctaccagtggaaacactggcataggtttggcattcatggcagctgctaagggttataaacttattataaccatgccttcttcgatgagtcttgaaagaagaaccattcttcgtgcttttggagctgagttagttctcactgatcccgccaagggtatgaaaggagctgttcagaaggcagaagagataagggataagactcccaattcttatatgcttcagcaatttgaaaatcctgccaacccaaaggtccattatgaaaccactggaccagagatctggaagggctctagtgggaaggttgatgctcttgtctctgggattgggactggaggtacagtaacaggtgctggaaaatatctgaaagagcagaatcctgatataaagctatatggcattgaaccagtagaaagtccaatactgtctggaggaaaacccggccctcataagatccaaggaattggtgctggcttcatccctggtgttctggatgttgatttacttgatgaagttgttcaaatttcaagtgaagaagctattgaaactgctaagcttcttgcattgaaagaaggtttactggtgggaatatcatctggtgctgctgcagctgctgcagttaagatagcgaagaggccagaaaatgctggaaaactcattgttgcggtcttcccaagttttggagagcgttatctatcgtctgtgctctttgaatccgtgaagcgagaagcagagagcttggtctttgagccttgaatgtcaagtcatacgagccatttgctgcttctcaagttgcattctgtccttgggttgtgtatatattttttctcttatggatctaaaaaataaaaaggatttctgtttgcttgttaattgactaagattcaataaaaatatagtagtttgctgaaatgttcaaactcgctcataatttgtagatcatgatgccgcgaactcatgcttgtactattttatttactagttaaattttgcttcttaaaacttgtaatggagaaaacactattacttattaacatgtggcatgctttttttttt

SEQ ID NO: 65 - DNA, 3446 bp, Glycine max
  misc_feature (1)..(3446): Glyma.15g046400.1
gattcatatttattatgaaattgatgaatgaaagaatttagactctttttttttttcatttttgtttagtaattttactcttctgataccatatacagaaaaaatccatgggtttaagggctttcattgatgcagtgatagtaaatgggttaaccggatattcgttctaatttacaaataaacatcatctacagatgtaatgcgttgaagataggaaagtttatagattgtacattgttatatgctgttgataatgatatgctggatgcgtgggattttaaatgtagcattcatttatatcatcaagctagttgttgtaattgtggtgaggggcttaagtagtagtttttataagttaacagattaaaattttagtgccaccaatgtataaaaagaagaaagaaaaagaaaaagctagttgctctaatcaagaaggtgacatgataaatatatgcttgcctactttcgacgaaatcaattcaccttgaaccttttttgctgtagaactagaatctagttgtgagaaaccttgatattgagatttcggttaggagtccagaaatttcttgagtacttgttactataattagggtggggtttaaattcaataaaactgtgagcagagcaagctctgtcattccacctgagatgaagtatatatgaaaaatctataatccataaagaagaaacaaagaaaacattatacaatgttatgtaattgagattctctgaagtttttattcaaactgcatgaaatcttagccacagaaaacgtttcattttatatgaaaatgaaaattataaatataatgcaacaaatataaagcattagatgtacaactgtaccatcttgcagctattttaaaactctagaggatcagaatctaaagatatgagagaatagaagacccagattatagttcatcattggcaataacgttgtaaggctggtgaaaggggagatggatttccttatcacagaactgagtgacatgtttaacctttaaataaaaaagtgatctagatcagagaaaggctgcagttcatggaagatagtggaaggtttgatgagaagtccttttcaaatggggatgtctacataggtatgatcaagggcatagtgcctcatgacaagggaaagtacacatggtcagatggaacggtatatgagggcgattgggaaggcgagaaaatgacaggaaagggactgattgtgtggtcatcaggagcacaatatgagggtgaaatctctggaggttacctacatggttatggaacacttacaacatctgctgggtgcatttatagaggaggatggaggatgaatgctcagcatgggattggacggaagcagtattccaattctgatgtttttgagggtttatggaaagaaggagttcctgaagggagtggcaggtatacttggaataatggaaatatgtatgttgggaattggaaaaacgggaaaatatatggtcgaggggttatgaagtgggttaatggtgatacttttgatggtttatggttaaatgggcttatgcatggaacaggagtttatagatttggagatgggggcctttatattgggacatggaataaaggcttaaaggatggaaaaggagtattctatcctgcaggtagtaaacatccatccttaaaaaagttgcatagccctcgtgatagtgatcataacggtttcttgttgaatgtagaaaaacaagaggctccaaaagccagagttaagcgtagcctttctgaaaacatgccggtcattagtagattcaaaagtttccgtcaaatatctcacaggacttcatcattgaaaataaatttgatccgtagtgattctgctcaagattgtgtatgtcatgattcttctcttacattatccaatgcgttggatggagatcaatctgaggcatcgggtgaaagtactttggtttatgaaagggaatatgtacaaggagttctaattatggagagaatttgtgagtgctctgagtcatcacgtgaaaagaaacagcaaaataagtttagtgtgaagcaagtaaagaagagttcatgtttggacatttttgaaggccggcgaagctattatcttaagcttaatttgcagcttggcatcaggtataccgttggcaaaattacaccagtgcctgcacgcgaagttcgatcatctgattttggggatcgagcaagaataaggatgtacttcccaagggctggttcaaagcttactcctccgcatagttcaataaacttctactggaaagattattgccctatggtcttcaggaatttgagagagatgttcaagttagatgctgcagagtacatgatgtccatttgtggagatagtggtctaagggacttgtcttctcccggaaaaagtggcagcattttctatctttctaaagatgatagatttgtgataaagactgtgaataaatctgaactaaaggttctgctcagtatgcttcctaaatattaccgtcatgtaggagatcatgaaaatactcttataacaaaattcttcgggctccatcggataacattaagaggtggaaaaaaggtgcgttttgtggtcatggggaatgtgttttgcacagaactacaaatccaccgccgatatgatctgaaagggtctaaacaaggaagatatacaaacaatgataaaatcaattgcaacacaacattgaaagatcttgatctaaaatatgagtttcacatggataaaaaattgcgagaatccctactcaagcaaatttccctagattgcaagttcttggagtctcagcatataattgattacagccttctgttgggattacatttccgagctccagagaatatgaaggccttcgtggaacatcatgaatcagtgcagcgtcaggagagtttaccttctggagatgaagggcagctcttgattcttcctaaaggcttgctgttagtttcccatgaaccgagtatagtcaacacggctcctggaccccacattagagggaacacattgagagcatactccatgggtgataatgaagttgatcttctacttcccggtattgcaaggttgcgggtgcagcttggagtaaacatgccagctcaagctactcgcaggcttcaggaggataaggataaggtggaggcaaaagaagtagagctttttgaggtatatgatgttgtcctctacatgggcgtaattgatatattgcagaactataatctgagaaagaaaattgagcatgcatacaaatcgctgcaatttgaccctatgacaatatcagtagttgaacccaagatttatgatgaacgtttcatcaaatttttagaggaaaaagttttccccaagaccccctgattttatttttctcccatacgtcacttcttggcttaatccatctatgtaattatttgtttcaaatcaaaggaagattgtttttttt

SEQ ID NO: 66 - DNA, 2327 bp, Glycine max
  misc_feature (1)..(2327): Glyma.04g079800.1
gtgtctcactgcatatatgaatatacgaaattacgagagagagagagagagagagagagagagagagagagagaagcgttaatctgaatgggttacatccaccatggaagaaccggtctcaggcacatactcagattcagaaccgccaccggcgtggtctcaaactccggcagatcgcaatcgcgcgctgcattcccctcccattcccctatcctcggcaacgtgctttttttctcaacaggcgataaatacctcaacgaaattaccgcagaggtggaacgcgacaggcgcagggagcgaaacgagcgtttgcgcctcggcctcgacaccgccgacatcgacacggagtcggagcaggactacatgggcgtggggcccctcatcgcgaagctcgagaaggagatgctcaaggaatcccccgagctgaaccgctacgaggagcccaccgactccgacgacgactccgacgaggaaaccaaggacgaggcggacaagaagatgagtgacttcgagaagaaaagagacaagcacacggacctgctcaagaacttcatcgaagccgaaaccctagatgacgcgtttaagtgcatgaccaaaatagacaacttcgaaaacaagcatttccgcctccggtccgagtatagggttatcggcgagctcatgaatcggcttaaggtctcgacggagctgaaggacaagtttgttttgcagaacaaacttaatagggcgttgaggttggtgcgatggaaggaggcttatgatcctgataaccctgcgaattatggtgtgattcagcgtgagcagccgacggcggatgcgaaggaagaggctgagttcgagaaggagaagcagaagcagatcgaggagggagataatgctgatgctgatgatgatgatgagcaggagtttgatgacatgaaggagaaggataatgtactgatggccaaacttgaggctattgataggaagctcgaggagaagttggcggagctcgagtatacgtttgggaggaaggggaaggcgctcgaggaagagatcaaggatcttgctgaggagagaaatgaattgactgagcagaaaagaaagcctctttaccggaagggttttgatacaagattgatagacatgaaccgaacttgtaaagtcacaaagggaggacaagttgtgaagtatactgctatggtagcttgtggcaactataatggtgttattggttttgcaaaagccaaaggccctgcagtcccagttgcccttcaaaaggcgtatgagaaatgcttccagaatttgcattatgtagagcgacatgaggagcatacaattgcacatgcagtacaaacgtcatataaaaagaccaaggtttatctctggcctgctcctactacaactggcatgaaagccggcagatcagttgaagccatacttcatttagctggtttaaagaatgtcaagtcaaaggtcattggttccagaaatcctcataatacagttaaggctgtcttcaaagcactaaatgcgattgaaacgccaagggatgtccaagagaagtttggcaggactgtggttgagaagtatctgttgtgatggacatggcaatgtggtcagttcagttgccgttggcggttgtcttccattggatctcttaatttgtactttttattcacgtgcatttaccaagaattggaagagattttcccgaatgcattacagatatcagcggggatagctcagttgggagagcgtcagactgaagatctgaaggtcgcgtgttcgatccacgctcaccgcattttttgttatgtttttttcttttagtttttgttcctcattctacaaactgcagggctaccgtatcagttgttttttttttttcttttcttcacttttattttttgttcctccttctgtcaaactaaagggctactacagtaatcattgaaaaaggagaagaaatcatgcaaagtgcaagttgggtgttggcatcttgaaacagagtcacagatggtacgaaaagcgtgaatgatttttctttaatgtctcttgacatagatctagttagattcatgagcaacagagtcagagatggtactaaaagtaaaaaaaaaaaaaaaaaaaactgataaatatttgcgtatagattcagtgtcgggtggaactggagccagccatcaatagctagaaagcttatcatcataataattaagcacaaatagtgtgtaactctgtgtagtgtgtaccctttttctttttcgcgtgtttgtcctcaaccccaaaagcttacaatgagtgttccctgtttttacatcacttgattaattatactttatctc

SEQ ID NO: 67 - DNA, 4516 bp, Glycine max
  misc_feature (1)..(4516): Glyma.09g182600.1
ggtttcttaatcttatcgcacttaaccaaacagccccttcttctccgcttagaattagaacgaacgaaacaacgaaagcgttactcttgcaattgcaatcagcgatagcgaaacatacacaccctatctctcttacacacacgcgcgcactcacgcgcacacgccatttctaactaagcaatcgacgcgccctgcagtgcagacctagagatagagagagagagaaatttttttcccggaaaattgagccacgagaaattttcccgacggaagagaaagaaaaaaattgaaagcgcatggcgacgccgctgacgggactgaacggcggcggcggcggagtggcggtgctgacgaatccggtgaacaaggtggattcctccgccaatggcggtggcggattcggccggtcgctgtcggagtcgccaattctgatattctcgttcttccacaaggcgattcggaacgagctcgacgcgctgcaccgattggcgatggcgttcgccaccggaaactgctccgacatccagcccctcttccaacgctaccgtttcctcagatcgatgtatagccaccactccaatgccgaagatgaggtgatttttccagctctagatatgcgtgtgaagaatgtagcacagacatattcccttgaacaccagggtgaaagtgatctttttgatcatctatttgagctgttaaactcttctatccataatgatgaaagtttcccaaaggagttagcatcctgcacaggagctctgcagacgtcagttagtcaacacatggctaaggaagaggagcaggtatttccactgcttcttgagaagttctctcttgaggaacaggcatctttagtttggcggtttctctgcagtattcctgtgaatatgatgacagaatttcttccatggctttcatcatctatatcacctgatgaatctcaggatttgcagaagtgcttaagcaagatagtgccggaggaaaagcttcttcaaaaggttattttcacctggatggaagggagaagtagtgctaacacagttgaaaattgtttagatcattctcaggtgcgatgtagtcctaatcctttaacccatcagaatgggaaaataaaatgtgcatgtgagtccacagcaactgggaaaaggaaatattctggatctagcatagatgtttctgataccatgagaacacatcctatagatgaaatattgctctggcataatgcaataaaaaaagagttaaatgagatagcagcacagtctagaaagatacaactctctggagatttcactaacctgtcagctttcaatgaaaggttgcagttcattgctgaagtttgcatatttcacagtattgcagaggacaaggttatttttccagcagtagatggaaagttttctttctatcaagaacatgctgaagaagaaagccaatttaatgagttccggtctttgattgaaagtattcaaagtgaagaagcaacatctagttcagaaactgaattttattcaacattgtgttcacatgctgaccatatattggaaatgatacagagacatttccataatgaagaagttcaggttcttcctcttgcacggaagcactttagcttcaaaaggcaacgtgaacttctctatcaaagcttatgcatgatgcctttgaaattgattgagcgtgtcctgccatggttgattcgatcattaactgaagatgaagcacagatgtttttgaaaaacatgcaattagcagctccagcaatagattctgctttagtcacacttttctgtggttgggcttgcaaggctcgtaaagatggtctgtgtttgtcttcaagtgtatcaggttgctgtccggcccagcgatttaccgatattgaagaaaatactgttcaatcttcctgtacttctgcttctgcattgtctggtagagtttgctcggtattagctgaatcagatgggacccaacaaagatcagtcaagcgaaacatatcagaggtgcacaagaatgaagatgtctctaaaacttcagaaattgaaagtattcagaaacaatgttgtagtgcccggtcttgttgtgtgccagctttaggagtcaacaagaataatttggggctgggttcactctctacaaccaagtccttacgctctttgtctttcactgcttctgccccatcccttaattctagtcttttcatatgggaaacagacaacagttcatgtgatgttggctctacagaaagaccaattgataccatatttaaattccataaagccatacgcaaagacttggagtatttagacattgaatctggaaagctttgtgatggtgatgaaacaattattcggcaatttagtggaagattccggcttttgtggggcttatatagagctcatagtaatgctgaagacgatatagtatttcctgccctcgaatccaaagaggcacttcataatgtgagccattcttacacgctggaccataagcaggaagaaaaattatttgaagatatttcatgcgttctttctgagctttctgtccttcatgaaaacatgcaaatgacccatatgtcagtggatttaagtgaaaatgattttggaatttctgatgccaatgataatatcaaagagtacaatgagcttgcaactaagcttcaagggatgtgcaaatctattagagtgaccctggatcaacatatttttagggaagagctcgagctctggccattgtttggaaaacatttcactgtggaagaacaagacaagatagtgggccggataattggaactacaggtgctgaagttctccaatcaatgttaccatgggtaacttctgcacttacacaggatgaacagagcaaaatgatggatacatggaaacaggcaactaaaaacaccatgttcaatgaatggctaaatgaatgcttgaaagaaactcctgtatctacatcacagacagaagcgtcagagcgtagcacttctcaaagaggtggtgattatcaagaaaacttgaacctgaatgagcagatgttcaagccaggttggaaagacatattccgtatgaatcagaatgaacttgagtcagaaatccggaaggtttatcgcgactcaactcttgatccaaggagaaaggcataccttgtgcagaatctaatgacaagtcgctggatagccgcccaacagaagttacctaaggctctatctggggagtctagcaaacaaatagaaggatgctcaccatcatttcgggacccagagaaagaaatatttggttgtgagcactataagcgaaattgcaagcttcgagctgcttgttgtggcaagttatttacttgcagattttgtcatgacaatgcaagtgatcactcaatggatagaaaagcaacattggaaatgatgtgtatgcagtgcctaactatacagccagttgggcctatatgcatgtcaccttcatgtaatggacttacaatggcaaagtattattgcaacatttgcaaattttttgatgatgaaaggaatgtttatcattgcccattttgcaatatatgccgtgttggacaagggcttgggattgattatattcattgtatgaaatgcaattgttgcctggggataaaatcagcatctcacaagtgcctggagaaaggcttagaaatgaactgcccaatttgctgcgacgacctgttcacatcaagtgcaacagtgagagctttaccttgtgggcattacatgcattcatcttgctttcaggcgtacacttgtagccactacacatgtccaatctgcagcaaatcattgggagatatggcggtttactttggtatgcttgatgctttattggctgctgaggagcttcctgaagagtacagggatcgctatcaggatatactctgccatgactgtgatagaaagggcacttcacgctttcactggctatatcacaaatgtggatcttgtggctcatacaatacccgtgtaatcaagagtgaggcaacaaattctagctgcctttagtgtgcttattttttgcaataaaagtacagagcttgtaaatatatttgtatagccaatccaattttccccaaaccaggaaactggttacctttcattttatacacaatgcgagtcacttccaaggaggcctctcatgagtttactttggcttctcgtatgccggagatagaagcaccaaatcaagtccatagttgtcatgtataggtaaagctttcttccaaacttgtttttgtagtggatactttacctcttcctcttttctgcttctagttttagttgaaagttcatttaagtgcgcactagcgttgctttacacagcaatcgttgggtaaagggagactatttgaactatgccagcttttgttagattctttttctttttctttttatgatgtgacgatatatactaaatgattctatggggcttacttaataaacaatagcatatcattttgagcacaattgtgtggttattctatcaatttagatagtgatagacgaag

SEQ ID NO: 68 - DNA, 1143 bp, Glycine max
  misc_feature (1)..(1143): Glyma.03g133200.1
cgaccacaccggctcttcggtggcggaagcgttgactggtctttcccttctcactctcttctcttcacaataaaaatccaatctgtgttgttcagcgcagcacgccaaatcaaagcgcgtgagaaaagcagaaatggcggcggctacggcgatttctcagctaggctgtttttccgccgtccaccgcagctcacacctccggcgccgctcgtttctgttcccttcccctcgctccaagttatcggttgttatgagtctggagaggcatgacacggatactgctgggtctgataccaaaaatacactaagttatgcagttgatgtgtcaaagctacatgttgaagaaaagaagaactcatattcaacaaaagatggccatgatgctgaaaaaatagggtttggagaggcaacacaggaaagtgtcgatcaaccgaaaaggactgcaaagattcatgacttctgtttaggcattccctttggtggatttgttttaacaggagggattattggattccttttttcacggagtcctgcaacactaagcagtggtgtgctctttgggggtgctttactattcctcagcacctttagcatgaaggtctggaggcaaggaaactcaagtttaccatttattctaggacaagcagctttggcaggggttcttatctggaagaacttccagagctactcattggcaaagaaaatatttccatcgggcattagtgctattataagttctgcaatgctctgcttttatttatatgtgcttatatctggaggaaatcccccgcctaagaaattgaaggcatctgccagcactgcatgatgagatagtcaaggttatgctagcctatatagaatatggggatatgattcttatttttctgtgaattgaaataagttttggatgaaaatctgataatttatatctatatttttttttataaatcataatcgttattttcagtccattttagctgtatattcagaattgggctacattctggtccacatgtgatgtattggatgttcaatgatttctgatcgaaatggattcagcttatattttctctgatagatacagttcatgcaaagattaagaaaaggagaaatggaaaacaaatggtgaagattaaattctgt

SEQ ID NO: 69 - DNA, 7203 bp, Glycine max
  misc_feature (1)..(7203): Glyma.04g236900.1
aaacactcactccctccctccctctctataaattcatcctttacttctcttgaaaccactgatctcaaaccatcacttacctggcggcggcgcagttcagttttctcatcacttcttcttcttccgtttgcatctgaaactgttggccttgttttgattcaacagaatatgactttgtgaattactataaaaaagccagatctgttgcttttcatccattaacgagggaaaaaaacattaatataacgagcaatttctcgtttttttctctcttctaattaaccagtttcctgaagcgatgtcgtgttctctctcgttttcaaggctttcggctcggtcagcgagaactcttccgcgcgaaaacgagaagccacgtctcaacgcacgatgtcccgtgagagtgacgaagtttctgggaacgcggctgcgttcgagtgggaggagcctccgttcggagagatttcacgtttggcagtcggagggtccgggtcggacgccgaagctcagggtcgcagttcggtcggctctttccgccgtgccgaacaagccgctcgggctttacgatccggctatggacaaggactcgtgcggagtgggattcgtggcagaactgtccggcgaaagtagccgccaaacggtgaccgatgctttggagatgctggtgcgcatgacgcacagaggtgcttgcgggtgtgaagccaacactggagatggagcagggatcatggtcgctctacctcaccagttttacaaggaggttgtggattttgagcttccgccaccaggaaaatatgcagttggcatgcttttcttgcctacatccaatagtcgcagggaagagagcaaaaatgtatttcaaaaggttgccgaatctctggggcattctgttcttggttggcgttctgtgcccacagataacacaggattgggcaaatcggccgtgctaactgaaccagtgattgaacaagtgtttcttactccaagtactcagtcaaaagttgatttggaaagacagatgtatatattaaggaagctgtccatggttgctatatcatctgcattaaacctcgataatgatggcattatagatttctatatctgttcgctttcatcaaggactgttgtttacaaaggtcagttaacaccagctcagttgaaggattactattttgcagaccttggcaatgaaaggtttacgagctacatggccctgatacattcacgattttctacaaatacttttcctagttgggatcgtgctcaacctatgcgtgtattgggccacaatggagaaatcaacacacttagagggaatgtaaactggatgaaggcacgcgagggcctactgaagtgcaaggagcttggtctatccgagaatgagttaaagaagcttttgcctattgtggatgcaaattcatctgattcaggagcttttgatggtgtgcttgagtttttgattcagtctggaaaaagtctccctgaagctgttatgttgatgattcctgaagcatggcaaaatgacaacaacatggatcctcagcgtaaagcattttatgaatacttctcagctctcatggagccatgggatgggccagctcttatagcatttactgatgggcactatcttggagcaaccttggacaggaatgggctgcgaccaggccgcttttatgtcacccacagtggacgagttgtaatggcgagtgaagttggggttgtagacattcctcttgaagacgtgagtcagaaaggaagactaaatcctggcatgatgcttctagtggattttgagaagcatattgttgtgaatgatgatgccttaaaggaacagtattcattggcaaggccatatggggaatggctcaaaaagcagaagttagaactcaaagacatagttgattctgttcatgaatctgaaagagttcctccatcaataacaggagtgatgccagcatctggtgatgatgtggatatggaaaatatgggaattcatggtttactggctccattgaaagcttttggatataccgtcgaatccttggaaatgttgttacttcccatggcaaaagatggtacggaagcccttgggtcaatgggaaatgatactccattagccatcatgtctaatagagaaaaactcacttttgagtactttaagcaaatgtttgcccaagtgacaaacccaccgattgatcctattcgagagaaaatagtcacgtccacagaatgtatggttggtccagaaggtgacttaacagaaatcactgaggaacagtgccaccgtctttccctaaaaggtccccttttatccattgaggaaatggaagccattaaaaaaatgaattacaggggatggcggagcaaagttatagatataacatactcaaagggccgtggtaagaaagggttggaggaagccttggacaggatatgtgcagaagcacatgatgcaattagtgatggctacactacccttgtgctgtctgatagagctttctcaaggaaacgtgttgctgtgagctccctgctggctgttggtgctgtccatcaacatctagtgaaaacacttgagcgtactagagttgccttagtaatagaatctgccgagccacgtgaagtgcaccatttctgcacacttgttggcttcggtgctgatgctatatgtccatatttggctgtagaggcaatttggcgactacaggttgatggaaagatcccaccaaaagcaaatggtgaattctactcaaaagatgagctggttaagaagtacttcaaagcaagcaactatggaatgatgaaggtgcttgcgaagatgggaatatccactttggcctcttacaaaggtgctcagatttttgaagctctgggtctttcatcagaagtgattgaaaggtgctttgctggaaccccaagtcgagttgagggtgcaacatttaagatgcttgctcgtgatgctcttcaattgcatggattagcatttccttctcgggttttctctcctggaagtgctgaagcaaaggcattaccaaatcctggggattatcattggagaaaaggtggggaaattcacttgaatgatccacttgcaatatcaaagcttcaagaggctgccagaactaacagcatagatgcatataaacagtactctaagctcattcacgagttaaataaagcttgcaatttgcggggacttctgaaatttaaagaggcagctgtgaaagttccccttgatgaagtagaacctgctagtgagattgttaaacggttttgcactggtgccatgagttatgggtctatatcattggaggcacacacagcattggcaactgctatgaataagattggagggaaatcgaacacaggtgagggaggtgagcagccatctcgtatggagcctctttctgatggctcaaagaacccgaaaaggagtgctattaagcaggttgctagtgggagatttggagttacaagttactatcttacaaatgctgatgaattgcagataaagatggcccagggagcaaaacctggtgagggtggcgaacttcccggccacaaggttgtaggagacattgctgtcacaaggaattcaacccctggtgtaggacttatcagcccacctcctcatcatgatatttactccattgaagatcttgcccaactaattcatgatctaaagaatgccaaccctgctgctcgagttagtgtgaagttggtatctgaagctggagttggtgtagttgccagtggagttgttaaaggccatgctgatcatgtcttgatctctggccacgacggaggtacaggggcgtccagatggactggcataaagaatgctggtctcccttgggaacttggcttggctgagacccatcaaactttggttgctaatgacctccggggtcgcactgttctccaaactgatgggcaaattaaaacaggaagagatgtggccatagccactcttcttggtgccgaagagtttggtttcagtacagctccactcattactcttggttgcatcatgatgcgcaagtgtcacaagaatacctgccctgttggcattgctacccaagatccagtactaagagaaaagtttgctggagaacctgagcatgtcattaacttttttttcatgatagcagaagaaatgagagaaattatgtcccagcttgggtttcgtactgtcaatgagatggttggccgttcagatatgctcgaagttgataaggaagtaattaaaagtaatgagaaactagagaacattgacctctctttattgcttagacctgcagctgaactgcgaccagaagctgctcaatactgtgttcaaaaacaagatcatggtttggacatggcattggataataagcttataggtctgtccaatgctgctttggtaaagggtctcccggtatacattgaaagtccaatccataatgtaaaccgtgcagtgggaactatgctaagccatgaggtgacaaaaaagtaccacttaaatggtcttcctactgacactattcatatcagatttaatggcagtgcaggccagagctttggcgcattcctttgtcctggcatcactttggaacttgaaggtgatggcaatgactatgttggtaaaggactgtcaggtggaaagattgtagtatttcctccaaaggggagtacctttgaccctaagcagaatattgtaattggtaatgtggctctatatggggccacatctggtgaggcatatttcaatgggatggcagctgaaaggttttgtgtgcgtaattctggagccaaggcagtagtggaaggtgttggcgatcatggatgtgagtacatgactggtgggatagtagttgtgcttggaaacacaggcagaaattttgctgcaggtatgagtggtgggattgcttacgttcttgatatggatggcaaattcctatctcggtgcaaccatgagcttgtagatctggataaggttgaagaggaagaggatattactactcttagaatgttgatacaacaacatcagcgccacacaaatagtgtgcttaccaaagaagtgctcgctgactttgagaatcttgttccaaaatttatcaaggtgttccccaaggagtataaacgagttttggcaagtattaaatcgaaggaagcttccaaagatgcagcggagtctgcttctaaacatggagaggagcaagatgaaattgaattggtggagaaagatgcttttgaagagcttaagaaactggctactgcatcggtgaatgggaagcctattgaggctgaatcattcaagaggcctagtcaagtcattgatcctgttaaacacagaggttttgttgcttatgagcgggaaggtgttcagtacagggatcccaatgctcgaataaatgactggaatgaagtgatgaaggaaacaaagcctggtccacttttgaaaacccaatcagcccgttgcatggactgtggtactcctttctgtcatcaggaaaactctgggtgccctcttggaaataaaataccagaatttaatgagttagtataccaaaataggtggcgtgaagcattagagaggcttcttgagacaaataacttcccagagtttactggtagggtatgcccagcaccttgtgaaggttcttgtgtccttggtattattgagaatccagtatctattaaaagcatagaatgtgctatcatagacaaagcttttgaggaggggtggatggtgccacgacctccagctaggagaactgggaaaagagtggccgttgttggaagtggaccgtctggcctggcagctgctgaccaactgaataaaatgggccatacagtaactgtgtatgaaagagctgataggattggagggcttatgatgtatggtgttcccaacatgaaagctgacaaagtggatatagttcaacggcgggtcaaccttatggcagaggagggaattaactttgtggtgaatgctaatatcgggcatgatcctttacattctctcgataggcttcgggaggaaaataatgctattgtcttggctgtaggagccacaaaaccaagggatctcccagtacctgggcgggagctgtcaggagttcattttgctatggagtttcttcatgcaaacactaaaagcttgcttgatagcaatctccaggatggtaacttcatttctgctaagggaaagaaagttgtggttattggtgggggtgacacgggcacagattgcatagggacatccattcggcatgggtgtagtagcattgtaaatctggaacttctccctcagccaccacaaactagggccccaggcaacccttggccacagtggcctcgcatataccgagtagattatgggcaccaagaaggtgcggcgaaatttgggaaagatccaagatcttatgaggtattgactaagcggtttgtgggagatgaaaatggagttgtgaagggacttgaagtaatacgtgttcgctgggagaaggatgaaactgggaggtttcaatttaaggaaattgagggctccgaggagattattgaggctgacctagttttactggccatgggattccttggccctgagtctacaattgcagagaagttgggtatagagcgagacaataggtcaaacttcaaggcagagtatggtcgcttctcaaccagtcttaaaggggtgtttgcagctggagattgtcgacgtggtcagtccttggtggtatgggcaatttcagagggacgacaagctgcagcacaagttgacagtttcctcacaaatgaagatttagagcacaatgttgccgggagtccagacgaacttatcaagaagaagcagcaaccaagggacactgtggcagtggcaaacaaacagtgattacttaggagccttctgtggtttttctattcttaaaagatggaataataaaagatgactgctggagattcattgagcattgttggttcgtagttggtgccccatataaatgtaagggggaaaataataaagaagcgatctaagggtgcaaggttagtgcacagtagaaaattaggaatgttcataggcttcgtgatggaaaggttagttcttagttaattattgtggcattgtgtggaatgaaatgtacagtttgataattaatgatttaggttattgtttccaatcttaagttgctttgaatgagtattgaggttcttgaatatccc

SEQ ID NO: 70 - DNA, 3747 bp, Glycine max
  misc_feature (1)..(3747): Glyma.14g137100.1
aaaaaacgaatagataacatgtgctcttaaacccttttttcactcccaaaaccctctcgttcacttcactcatcgcattaacaatgaaatgaacagcaacacatcacaacaacaatgattcaacttcacagaaccttcttctccaccaccacctcctccgttccttcctcataccctctctctcttggccacttcatgttgcagttcagggcgctccaggctccaccaattgctctcgcgccgcacgccacgtcatccctcatcggcgccaccgtccaatgccgaacgcgtcttctcttccctcgaagggttaccgcgaaatgccacgcgacgtcgtttagcaatttccgtttcccgtttgctttgaactccacgacgtcgtttgggggcagcgttttctcgagggggtttgcgacgcgcgcggcggagaacggtaagcagaagaaacgggcgagggctgctgtcgttcgcggaaaggagaaggacgaaggtgtgataaatgacgccgcgccgaaagagtttgacaatgtgaccgcttctgagggaagtttgggtgagaagaagaagaataagaagggatcgtcacccgtcgccgctagtggcaaagaagatgagaagagtgtgaagaagaaaacggcgaagaagaagaccacgacgactttgcggagcaagaaggtggctgccagcagcacccaagaggatggtgctgctgaagcttctaaaaaatcttacaaagggaagaagaagaaggattcgaagaagagtttgaccgagagtgctattgaagaaatgccggagaattctgcttctgcaaaggacgagttgaagaagaaaaatgggaattctagtgtgattgaagaggtgaaacccccatggaattttacgtacaagccattgtatcctcccactagaaagtctgtggtggttgtggagtctgttacaaaggcgaaggttattaagagataccttggtgatatgtatgaagtcttgccaagctatggtcatgtgagagacttggctgcaaggtctggatcagtgagacctgatgatgattttagtatggtgtgggaggttccgccgcctgcctggactcatttgaagagcatcaaggttgcactgagcagagcagaaaaccttattcttgcatcggatccagatcgtgagggagaagctattgcttggcacatcattgagatgttacaacaacagggtgctctacacgataatatttccttagcaagagtagtctttcacgaaataactgaaaaatccataaaaggtgccctacaaacaccacgagagattgacgtaaatttggttcaagcttaccttgctcggcgggctcttgattacttgattgggtttaacatttcaccattactatggaggaagttaccaggttgccaatcagctggaagagttcaatctgctgcactttctcttatatgtgatagagaaatggaaattgatgaatttaaaccgaaggagtattggactgtggaggttcaaatgaaaaagaaagagctgagatcaaacaagaaccttacttttcctgctcacttgacccattttgattcaaaaaagttgaataagttttcaattacttctgataccgaggcaagagatattcgaagcaatataaactcagctgattttcatgttgttagcttgaaaaaaaacaaaagtcgaagaaatcctccaacaccttatataacatcgacacttcagcaagatgctgcaaacaagttgcatttcactgcaagtcacacaatgaagcttgcacagaagctctacgagggagttgaactgtctgacagtgtagcagtgggtctgataacatatatcagaactgatggactccatatttctgatgaagctgtagctagtatacgctcgctgatcattgaaaggtatggacaagattttgtctcacaaagtgcaccaaagtattataaaaaggtgaaaaatgcacaagaggcccatgaagccattagaccaactgacatacgcaagttgccatcaatgctttctgcgatacttgatgaagaatccttgaagctctacacacttatttggtcacgaacagtttcatgtcaaatggaacctgctgtctttgagcagatacaacttgatattggaaatcttgatgagtctattatattacagtcttccatctcaagggttgagtttcctggatatcgagcagtttttacggacattgttagtgaagctgttcaagataaaggcagtgatgaatccagccatgatcaaacatttggagtactaaattccttgaagacaggggattcattacacgtggttcaaactgaacctaatcagcaccatacacagccgccaccacggtactctgaagcatcattggttaagaagcttgaggagcttgggattggaaggccatcaacatatgcatccacgataaaagttttgcaggatagaaactatgtgacagtaaaaagtcgagttctgtctccagaatttcgtggtcgcatggtttcagcttttctgtcgaaccatttttcagaggtcacggactacagttttactgccgatatggaaaccgagcttgataatgtttctgctggattaactgaatggaaaggcctccttagagactattggacacgatttaaatcatattgtgagcgtacttccaatgttcatattcatcaggtagagaagatgttggaaaagaaatttggcgattatttatttgcttctctcccagatcagagtcgggtgtgtccaagctgtatggaaggcacacttatttttaaagtaagtagatttggtgctgggtactttataggctgtgatcaacatccgaggtgcaagtacattgctaaaacattatatggtaccgaggaggaagaggatgcatctcagccaaacactagaatagaggaaccaaaactccttggtgttaccagtggttcaaatgaaaaggttcttttgaaaagtggtccttacggagtctatgttcagctcggagaagataggaagggatacatacctagaagagcttctgtctctcatatcaaggatgtggattctatcactcttaaagatgcacttgaggtgctacaatacccattgacattgggtaaccatcctaaggatggacagcctgtcatattaaggcttgcaagagctgggttttgtgttagacatcggcgaacaattgcttctattcctaagaatgtgaagccaagtgatgtcaccctggaaaaagcccttgaatatttatctggtgatgatgtgagacgatctggtcgtccaaaaaaaggcaaatctaaagttgaagttgaagttattgaagcgttttaagttttcggcctgtctctagcatattttcagagttttctcgtgattgagattgattacattaagctactggcaatttcgaacaattttccgaccagagtttgcgaatccaatcccagacaagtcctggaagattcttttatggagccaaatgtatatttattactgttttagaaattttgttgagtgtctctatttttggttacctgtctaacgttaggccaatatgacatttacttttgatagaaatttgttatagcaattgaacttgattagaagccctgaacgctgagattttgagcagcctatgggttgatattcttttgttgtatactatactataaagccgatcaagggacgcgtacaacaaattcatagaaaagcctattcattaccttttcttaa

SEQ ID NO: 71 - DNA, 1984 bp, Glycine max
  misc_feature (1)..(1984): Glyma.13g275400.1
tcacgtttagcatatagttttatataataataaagttgtttggcttatattaatatcaccaaaaattcaaagtgcttccttacacatatatatggaaaacgtggagcagataaaagaggagatagagaagatggtggcaagttctagttcagaaggaacaggagtacccctattgagagcatctgataataatggaagagatcaaaacacaagatccccccaagctgagggatggtggaacaaagtgttggacatggaagaggccaagcaccaactcttgttttcactgccaatgattcttaccaacttgttctatcacttgatcattttggtttctgtcatgcttgttggtcaccttggtgagcttcagcttgctggtgctactcttgcaaattcatggttcagtgtcactggcgtggcagttatggttggtttgagtggggcactggaaacactctgcggacaaggatttggtgcaaaggaataccaaatgctgggaatttacctacaagcctcttgcatcatatctcttattttttcaatcattatatccattatttggttctatacagaacccatcctagtgttgcttcatcaatctcccgacattgcaagaacagctgcactttatatgaagtttcttatcccgggagtgtttgcttatagcttcttgcaaaacatcttgaggtttctccagacacaatctgtagtaattccattggttgtactctctgctcttccaatgctggttcatattggtgttgcatatggcttggttcagtggtcaggtctgagttttacaggtgcaccagttgctgcttctatttcactatggatatcattgctattattggccttgtatgtaatgtatgctaagaagttcaagcagacatggaaaggattttcaacgcattcatttcgttacgtatttacaaacatgagactagctctgccctctgctgcaatggtatgtttggagtattgggcttttgaagttttggttttcttagctggactaatgcccgactcacagataaccacttcgttgattgcaatatgtataaacacagaattcattgcctacatgatcacttatggtctcagtgcagctgcaagcacaagggtatccaatgaattgggagcaggcaacccggaacgagctaaacatgcgatgagtgtcacactgaagctctctctcctccttggattatgttttgttttggcacttggatttggtcacaatatctggattcagtttttcagcgacagttctacaattaaaaaggagtttgcttcagtgacacccttgcttgccatttctatattacttgatgccatccaaggtgtcttgtcaggggtgtccagaggatgtggctggcagcacttggctgcttacattaaccttgctacattttatcttattggtttgccaatatcatgtttcctaggatttaagaccaatttgcagtacaagggtttatggattggtctgatttgtgggttactttgtcaaagtgggactctcttccttttcataaggcgtgccaaatggactaaattggatctctctagggacaatgataaagaacggcctcttgttgtttaactgaatggaattggacttatggtaaaaaaaaaagaaaaaggtttgcattctattatgcagaagtttatcagatagggtgaacactgaacatgattttggtgaagcgtttcttgcttatattcattttgagaaagtgctcacacttttttttatattttatttgggagtgttggtgagttgcagagagtaaatcttggcatataatgtaacagtctcacgggaacacatcaagaatagatggggagtaatgtatcccaccgtgaaaagaatactataaaaaaactaggaaactacgtgtaattgacaatggagaaccatatgattgatgatagattattttctcgcgtgagaagtgggactctcgaatttaaatttaaa

SEQ ID NO: 72 - DNA, 1217 bp, Glycine max
  misc_feature (1)..(1217): Glyma.05g150300.1
acaaaaaaacaagatactttccttgcgaaagaacaaagcatttgaagaatcactagtgactcactcaccatcttctgtctctgcactctacaaagaaaagaaacatgatgaactttgacggcttccagaaggctctggcggagtttcagggccgctgctccacgctgctgggcagcctgacccgtctccagcccaaccgcgcgaggccaccatgggctcggatagcccagccctggggaggcaggcccatggccatgacggtggaggcaatcgaggagcgcttagagggaattcccgtttacgccctcagcaacgcttccgaggagtttctcttggtctcgggctcttcctccgggaaaaaccttggcctcttctgcttcaacaaggacgacgccgaggctctcctcaaccaggttacgcttatcgacccccacgctcgccagggctccaaagttgtccccgttgctttgaacaaggtgtttcagctcaaggtgaacggcgttgcgtttagattgatacctgagttctctcaagtaaagaatgccctgcaagagagggaaaaatctggctttgcttccagtggcttttctggtgttccagttttccagtccagaagtctgatattgaagagccaaaataagagatttcgtccacttttcttcagaaaggaggacttggaaaatacacttaaatcggcagcccgtgagcagaacaaattaaatcccactatgagaaaaggagatatccaggttgccactctagaggatgtaataaaagaaatgaaggaaaattctacatcgaactgggatgatgttatttttatacctcctggatttgatgtttcagacgactccaatgagcagtagggcaggatgatgattaaattcatgacaccttttatgcttgtggtattagcttttaatccatagcacatggcaaacaattatttaggttttgtgcatacgacaaacttctgactgcagactcttctatcctgtcttcaatatgaaacgttattggaaagtttgggttttgcattttctaatttggttttcattatcaagtaggttttatcagacttcataatctttattactaatgtacgctaactgaagtctgaaatatcgtgtaccacttggaggtgcatcacttgatcgtgagattgctattgattgatttggggcggtggtaagatcacaaatggtagttatctctga

SEQ ID NO: 73 - DNA, 2342 bp, Glycine max
  misc_feature (1)..(2342): Glyma.13g194900.1
ttttcgctatgggtgatggtgtcccagcaataatgctcggtgcacaggtcgctcctctttccattcgaaatcatgtcggaacccaagatacgtgatgtgctgatcagctgcgccgaagacacacaccaaggttttgtgggccatctctttaaatctctcacagatctcggattctccgtgaaggtagtctcaggagaccatcgggatcttaaggaagaggaaattgaatgcttcagggttttcattattgttttttcccatcactatgcaacttcttcatctcgcttggataaacttaccgagatcataaataagtacggtgcggcagaagatcgacgcatttttccatttttcttcgaggtggaaccgaatcatgtacggtttcaaagtggtagttttgaaatagcttttgattctcatgccaaccgtgtggagtctgagtgtttacagaggtggaaaattactctgaaaaaagtaactgatttttctggctggagtttcaatcggtccgagaaaacatatcaataccaggttattgagaaaatagttcaaaaggtctctgaccatgttgcttgctcagttggattacattgtcgagtggagaaagttaatgatcttttgaaatctgaatctgacgatacagtgagggttttggtatatggagaatctggaataggcaaaacaactgtagttcgtggagtttgtcgttccaatggggggaaatttgcctattattgctttcttgagaaggtgggagaaaatttaaggaatcatggatcaagacatctcataaggatgcttttctctaaaataattggtgacaatgatagtgagtttggaactgaagaaatattacggaaaaagggaaaacaactgggaaagtctcttttggtttttgaagacatttttgatcaagagcagttggaatacattgttaaagtagcatcagactgctttagtttcaactccaaagtcattattacagctgagaaaaattgtttcctaaaatgtcctgagattgaaatatatgaggtagaaaggctcacaaagcaagagagtactgatttgtttattttgaaagcgtttaattgtcggaatccaaaaattaagcatttgaaaattatcacacaagcagtaactatggctccttgggttccatatactttggaactgatagcttcctactttcgtgaaaaaagtgcagaacattgtcagcgtatattagatgaatatgaaaaaattccaaatgaaaaaaagaaacaagtgatagttcaaatgatctttgatgctttgagctgtgatcagaagaaaatgttaattcatattgcctataacctcattggacaagaaaaggcaatagttgaagacagacttcatcgtctttttggtgtttgggcaaaagatggtattgacatgttgcttcataaatctcttgtaaagattgatgagcaaggtcaggtgacaatgcaccacttgacacataacatggtaaaagatatggagtatggcaaaaaagaagaccaacctgcatcaaattatgggagcatgtgtgatttgatggaattggacaaaaacgggtatgtcatggaagaaatccaaccttcgtctaatgattacgaaccaatggaatatgaatatcaaaattgttctacctcctcttcttgagatccttcatgatgttatttaagatctgcttccctcttttccaagatggacgagaggcggcacatcctctttttatttttttattctgaggagggcttaatgcccaggaaaactgaacacaaatcgtacgggacatagggagccccataatgtccttaaccaagagcatatcacacccaggaggcggtgagctcttaacatgcaggtcaatatcttcatgaaaggtgacacatctgaatcaccctggattagtttttggcttgaagccataggttttgatagtagtcatgtaggtggtattgggggttctcctcgtaactctccactgtctagtgactctggtgagtcttataactccttctgacctttcaaggttagagttggagcttacattccttttgggtgcctaaggatgttttggatcatgtctggtagagttttgttgttcgttaagtgattgtaatgtttgtatgtaacaatcatgtcggattaggtcctgctggagttattcgtgatattttgtatatagttacatgtcacatgtgtctgctttgtagaccttgatgctcttatatttataagtgggatgcaagtttgttcctgcttgttttatattccacaatcctttacatgtttataaaagtgcttatcaggtatcaagagaaaaaatattgtat

SEQ ID NO: 74 - DNA, 4459 bp, Glycine max
  misc_feature (1)..(4459): Glyma.06g208900.1
gaagatccaatagcagcatgtgcacgttttaagtcttttcttcgttcttagctacaagtcaaactgatatacctgtctgatttcagctactaacccaaagaaacaaacaacattttctatgctgcttcacttataattatttcactacaaagttcttcttttcaattctgaacactgcacacatatatattcttaatctttctggcctccgtattcttgtctttttctgcttcaatcattataggacaggtgcatttttggttcaacacacacatatctcttaccttatagtacacaatgaacttcttttaatcttttctaacaaaaattgccctttttcttttcattttattggttcgataatgccgtgtttctttctttcttggccttcctatcgacagtgactgtgtttggtgctgccttgggataaagtgaacaaaactagttgatctctgcaaatctgttttttttttttttttttttttttttttaaggattttcaagtctgaagcttatttaagaggggaattatgcaaggttgtaaacttgtaatgtattgtgattataatttgtactattataagttgtaagcttttggagaagcaaagttgttgaagttatggaaggtaatggtagaaggaggaggcgccacttcagcagaatccatgcattctcttgtggaaaagcttcattcaaaggggagcattcactcataggcggtcctggattctcaaggatagtgtactgcaacgaagcggaacgcggtgaggggagtcttgtgagctatggtgacaattatgtgagtactactaagtatacagtggccactttccttcccaagtccttgtttgagcaattcaggagggttgccaatttttacttccttatctgtgcaattctgtcttttttcccggtttctccttactcggctgtcagcaatgttgttcctcttgtggttgtggttgctgctacaatggggaaagaggctgttgaggattggaagaggaaaaagcaggatattgatatgaataatagaaaggttaaagtgcaccgtggagatggtgtttttgactattctaaatggaaggatttgaaagtcggggacatagtaaaggttgaaaaggatgaatttttccctgctgatctcatcttactttcatcaagctatgacgatgcaatttgctatgtagagaccatgaatcttgatggagaaacaaatctaaaagttaaacaatcacttgaagaaacttcaaagttgcaagaagattcaagctttcaaaatttcaaggctattatcaaatgcgaagatccaaatgcaaatttgtactcgtttgtaggcagtttggagcttgaagatcaattgtatcctctttcacctctgcatctactgcttagggactcaaagctaaggaacaccgagttcatctacggtgtggtaatctttacaggccatgatacaaaggttatgcagaattcaacagaacctccatccaagagaagcacagttgagaagcggatggataagatcatctactttctgttcttagtcttatttttaatttcttttattggttcaattttcttcgggattgcaacgaggaaggaccttgaaaatggagttatgaagcgatggtacctcagaccagatgacaccacaatttactttgatccaaagaaagcaccagtcgcagccatgctgcacttcctgactgcacttatgttgtatagttacttgattccaatttctttgtacgtttccattgaagttgtgaaagttcttcaaagcattttcatcaaccaggatttgcacatgtattatgaggaagctgaccggccagcacatgctcgtacctcgaatttgaatgaagaacttggccaagttgatactatactttcagataaaacaggaactttgacttgcaactctatggaattcatcaagtgttctattgctgggattgcgtatggccaaggagttacagaagttgagagagctctagccaggagagaaggagtacctttaagtcaagagttgacagaagatggaaatgttccaaagtcttccattaaaggttttaactttatggatgaaaggatcatgaagggaaattggatcaacgaacctcacgccgatgtaatccagaactttctgcggttgttggcagtatgccatactgcaatacctgaagttgatgaagaaatcggtaaagtttcatatgaagctgagtcacctgatgaggcagcttttgtggttgcagccagagaacttggttttgagttctatgaaaggacacagacaaatatttcactgcatgagttcaatccgagatcaggccaaacaacagaaaggtcgtacaaacttttgaatatattagagtttagtagtacaagaaagcggatgtctgtaattgtaagagatgaggaggggaaactgctactatttagcaaaggagcagacagtgtcatgtttgaacgacttgcaaggaatggaagggagtttgaagagaagactaagcagcacattgatgaatatgctgatgctggtttgaggaccttgatacttgcgtatcgggaacttgatgaagaagagtacaatctattcaatgaagaatttatggaggccaaaaacttagtgagtgcagatcgagagcaaattgtggaggaaatatcagaaaagattgagaaggatttaattcttcttggtgctactgcagttgaagacaaacttcaaaatggggttcctgaatgcattgacaagctagcacaggcaggaattaagctatgggttctgactggtgataaaatggagacagcaatcaatattgggtttgcttgtagtttactcagacaaggaatgaagcaaattataattagttcagacactccagaaaccaaatcactggagaaagtggaggacaagtctgctgctgcagcggcagttaaggtaagtgttattcatcaattaacgaatggaaaggaattacttgctgaatctgatgaaaactctgaggcattagctcttatcattgatgggaagtctctcacttatgcactagaagatgatgtaaaggacttatttcttacacttgctgctggctgtgcatctgtcatatgctgtcgttcatctcccaagcagaaagcacttgttactagattggtaaaggttaaaactggcagtacaactctagcaattggtgatggagcaaatgatgttggaatgcttcaagaagcagacattgggatcggtatcagtggtgttgaaggaatgcaggctgtaatgtcgagtgatatcgcaattgcccaatttcggtttctagagcgtttacttcttgtgcatgggcattggtgttacagaagaatctcatcaatgatttgctacttcttttacaagaacattgccttcggcttcaccctcttcttctacgagatctatgcgtcgttctcggggcaagctgcatacaatgattggtacctctcactatataacgtattcttcacttctcttcctgtaattgccttgggagtgtttgaccaggatgtttctgctagactatgccacaagttcccattattatatcaagaaggtgtacaaaatgtcctattcagctggaaacggatcctcggttgggctttcaacggagtcttgagtgctaccataatattcttcttctgcatcaacggaatggagaatcaagcattccgtaaagccggggaagttgctgatcttgaagttcttggtgccaccatgtacacttgtgttgtgtgggtggtgaattcccaaatggcattgtccattagttacttcacttacatacaacatttattcatatggggtggcattcttttctggtacatattcctcttagtgtatggaaccatggacccttctctatcaaccactgcctataaggtcttgattgaagcttgtgcaccagcaccatcttactggctcatcactttgcttgtgcttgttgcttcactccttccatacttcgcctacgcttcgatccaaatgcggtttttccccacgttccatcaaatgatacagtggatacgaaatgatggccaaacaactgatccagaatatgttaatattgtgagacaaagatcaataagacacacaacggttgggttcacggctcggtttgaagcatcacatagttcaggagcatccaagagtattcaagtctgaaaacaatgttagcaattaagcaatgttttttctgtttctttgttgtatttaaagttctttggtctgaacataggcgtaaatttggtataggtaatcaatcacgtacttcggattgtatatatttaaggtagagatgggtcttatgtagttgacaaagaaatgtcaagagatatgctctttgacaaaggtaaacaagtaatcaatgcccagaaagataatgaaaaaattggcgagtaatgaaagattaaagagcttcctttgcaggtt

SEQ ID NO: 75 - DNA, 1707 bp, Glycine max
  misc_feature (1)..(1707): Glyma.20g025100.1
atgatgagaaacttgcaaatccagtaatttaccaatcgctactaattgactcgtgcggtgaaaagatcccatcagaatggatctggaaaaccactgaacaagaagaagagtcttcttcgtttaaccaccacatcggagaaacacaaacacacgcgcgcacacacacgtgcgtggtgcagactctccagtctcacacacatgtgtccgttgctgctgtaaccgtcgacgaagaagaagaagaaagaaataaaccgtttaaagtaaagcaaaattcgtaaaccaaacaaacccttatgcgtggtgactagtgagtgacgactcagatctgttgcggggttatcgaaattggttattggccgagggagatggaggggaactccggtggaggaggcggcggtggcggtggaaacgacgtggaattgctctgcaagacgctgcaggtggagcacaagctcttctacttcgatctgaaggagaatcctcgcggccgctaccttaagatttccgagaagacctccgccaccaggtccaccatcatcgtccccttctctggcatttcctggttcctcgatctcttcaattactacgtcaattccgacgaccaggacctcttcagcaaggaattgcagctcgacaccaaggttttctattttgacattggcgagaatcggaggggccgttttttgaaggtgtctgaagcttctgtcagcagaaaccgtagcactataattgttccggctggaagctccagggatgaaggatgggcagcattcaggaacattttggcagagatcaatgaagcctcaaggcttttcattctgcccaatcagcaaaattctgaatcctcagagcatcttgttggactttcggatgatgttggtgctggcttcatatctggtcatagtactcaacctgccacttcttctgagttgaatgtggacaggtctgttgatttgccgcctcaggatgaaattgggaacttgggggtctcaaaagtgatcagggctgatcagaaaagattcttctttgatcttgggagcaataataggggtcatttcttaagaatatctgaggttgcgggttctgatagatcctccattattcttcccctgtcagggctcaagcagtttcatgagattgttggtcactttgtcgaaatcacaaaggaccgaattgagggaatggcggttgctaatgttcgcacaattgatccccctcaaagatgaatgctaacttgggataagaatgggtgttgtcttcgagtctgatttgtgttattttattttattttccctcagcctcctttcttcttctcatattgttcttccattaatgcttttgaaataatgcaaactctggttggtcagcagaataatttgaattgcttggcaaggttaatatgaataggaataacggaagaaaaaaaggatcagagacttgtacttgtttggatagtttggcacccaagctacaatctgtaataatgtttgattgtttattttgcgttccttgcacagatttcgcatggatttaagttctcatgcctaccatatgttaggttggtgacttaactattttgtagggtttggtttccatctaacagcatgaactttgctttcatagtgatatctgttttatcgtcatttatctgtttcatctgtattaaacacaccctatggaaggagggatgtggggaatgcttttagg

SEQ ID NO: 76 - DNA, 13699 bp, Glycine max
  misc_feature (1)..(13699): Glyma.16g071500.1
atattacaagtggtactgtcacttctatggcaatttagtaatattttctatccaagtatattaatacacacatgcacacatatatatatatacactaaggcttagttttgattagatttcacaaagctctggcagagcttacagaattgagctagctatctaagatttaggacacgaaaattgaagcaaaactacacaagatatttatttcttgttgaattcaccaatattctttatgcaatttcaccctctaccgagtaggtcacgcgtgcaacatggaagctgaaaccaattctccagaagatgcatctgctatggcatttggtcaacaccaagtgacagaccaaacaagtgtagaaaatgtgcagccagctgaaaccctgattgaagtgaagaaccaggagaacacaaatataaagcatccaaatttggaaggagagactacagaaataaacccaactaatgacaccaaagaacaagaaaaggttccagtgtcacacactcgagaagagatagagaatgaggatgatgggaaatacaaacaaaagaaagcaaaagagacagaagaagcaaccgaaatgcagttattaaaaactgcaacagacagtccacctgaggataatgtccagtcaacagtgcccacttctgaaattgtcaaaggtgaaactgaggaaatctcacagcaacaaacatataaaaatgatgaaacagtagtgattgacactgacaagacaacattgcaacaaggaatagaggatggtggcaattttgatcaacaagaagcaacaaaaatacagttactgaatgaagaagtcaagacaacattacccactcctgcctttgtccaagttgatactgatcaaatttcacagcaacaatcactgcataatgatgaatccaaagcgattgttaatggcaagggctgcatacctgaaattgaacatgacagagagtacactgttgctgaggaacctgaacaacctgaaaccaaggacaatgtcagcatagcacaagaagaaaaagcagaccaccaatcagaagagtcaagcctgcagagtgtcattacaaattatatcaccgcagaaggacctgtcacatcacaaagcatcacaaaattaagcgatgatgctgacaatgatgaacagaagacagtagaatcatgctcggcaaacaatttacaaaacaaggatgcaagagaaattatagcagaggaagcaacagatgccaaacaatcaactgatgtggatataccaaagtcagaaaccaaagacatgcctgaagataaagccctgcaaacaatacccaacacaacatcagtcggaaatgaagcaattgatgacagtagtcaagaagagagacagccagaagcagaatttacagagaaatttaacaaagagttgcaggcgccacactatgatactgaggaacaaaaggttccagcatctcatgcaaaggaaaaactaggggtcgaggatggtggcaaattcaatcaagaagcaaaaggtattgaagaagcaacaaaaatgcaattaccagaggaagaagtccggacaacattgcccactcctgcctttgtcgaaggtgatactgatcaaatttcacagccacaaacactgcacgatgatgaatcagaagcgattgataatgccaagagttccattccagaaattgaacatgacagaaattatacttttgttgaggaacctgaacaacctgaaaccaaggacaacatcggcatagtaaaagaagaaccagcaagccaccaatctgaagaatcaagcgtgcagagtatcaatacaaattgtataacagcagaaggacatctcacattagaaagcagcacaaaattaacagataatgttgaccccaatgaacagaagacagtagaatcatgctcagtggagaacttatacaaccaggatgcaactgaaatcgcagcagaggaagcaacagatgcaaaacaatcaactgatgtggagacaactcaattagaaaccgaaggtgcgtatgaagataaatccctgcaaccaacacttgacgaagcatcgatcggagacaatacagttgttgagagaagtcaagatgaaagacagccagaagcagaatttaaagagaagattaacctagagatgaagactccacaaaatgataccaaggagacggcagaaataaataccaatgatactgagaaacaggaagaggttccagcatctcaggccaaagagaaaatagggattgaggatgacggcaaattcaatcaagaagaagcaaaagggattgaagaagcaataaaagcacagttaccagaggaagaagtcaagacagcattgcccactgctgcctttgtccaaggcgatactgatcaaataccacagcagcaaacactgcaggatgatgattcagaagtgattggtattgcgaagaacatcgacactccagaaattgaaagtggcggaaggtccactgttgttgaggaacctgaacaacccgaaaacatggacaacatcggcgtggtgaaagaagaacaagcagaccaccaatcggaagaatcgagcgtgtcgaatgtcagtacaaaacacacaacagtggaaggacacgacacatcagaaagcagcacaaaattaactggtgatttcaatggtgatgaacacacaatagtagacacgcgctcagaagagaatttagagaacaagaatgcaagtgaaattaaagcagagaaagaaacagatgcaaatcaatcgaccgatgtgaagactcaaaagacagacaacgaaggtgtgcatggagatgaatccctgcaaccaacacttgacgaagcatccatcggaaacgaaatagttgttgagagtagtcaagatgagagacagcaagaagaggaatttacagaaaagtttaatgaaaagttgaagactccacaaaatgataccgaggagactgcagaaacaaacaccaatgatactgagaaacaagggattgaggatgatggaaaattcgatcaagaaaaagcgaaagggattgaagaagcaacaaaagaacagttaccagaggaagaagtcaagacagcattgcccactgctgcctttgtccaaggcgatactgatcaaataccacagcagcaaacactgccggatgatgattcagaagtgattggtattgcgaagaacatcgacactccagaaattgaaattggcggaaggtccactgttgttgaggaacctgaacaacccgaaaacatggacaacatcagcgtggtgaaagaagaacaagcagaccaccaatcggaagaatcgagcgtgtcgaatgtcagtacaaaacacacaacagcggaaggacacgacacatcagaaagcagcacaaaattaactggtgatttcaatggtgatgaacacacaatagtagacacgcgctcagaagagaatttagagaacaagaatgcaagtgaaattaaagcagagaaagaaacagatgcaaatcaatcgaccgatgtgaagactcaaaagacagacaacgaaggtgtgcatgaagataaatccctgcaaccaacacatgatgaaacatcgatcggaaacgaaacagttgctgagactagtcgagataagagacaaccagaagcagaatttaaagagaaaattaacgaagaggtgaagactccacaaaatgatattgaggagactgtggaaataaacacaaatgatactgagaaacaggaagaggttccagcatctcacgccgacgagaaacaagggattgaggatgatggcaaattcgatctagaagaagcgaaagggattgaagaagcaacaaaagcacagttaccagaggaagaagtcaacacaacattgcccattactgcctttgtccaaggcgatactgatcaaataccacagcagcaaacactgcaggatgatgattcagaagtgattgatattgccctgaaaatcgacacttcagaaactgaacttgctggaaggtccaacattgttgagaaacctgaacaacctgaaaacaaggacaacattggcgaggtgaaagaagaacaagcagaccaccagtcagaagaattgagcgtgtcgaatgtcagtacaaattatataacaccggaaggacatgtcacatcagaatgcagcacaaaattaacaggtgatgtcgatgtcgatggacggacaatagtagtcacgtgctcggaagaaaatttagagaacaaggatgcatgtgaaattacttcagagaaagaaacagatgcaaatcaatcaactgatgtggagataccaaagacagaagccaaaggtgtatatgaagataaatccctgcaaccaacacttgacgaagcattgattggaaacgaaacagttgctgagagtagtcgagatgacagacagccagaagcagaatttacagagaagattaatgaagaggtgaagcctccacaaaatgataaggaggaaactgcagaaataaacacaaatggtactgagaaacaggaagagattccagcatctcaggccgaggagaaactagggattgaggatgatggaaaatttgaccaagaagatgcaaaacagattgaagaagcaacaaaaacacggttaccagaggaagaagtcaagaaaacattgcccactgctgcctctgtccacggcgatactgatcaaataccacagcagcaaacactggatgatgatgattcagaagtgatggatattgcaaagaacatcgacacaccagaaattgaacttggtggaaggtccactgttgttgaggaacctgaacaatccgaaacaaaggacaatgttggtgtggtgaaagaagaacaagtagaccaccagtcagaacaattgagcatttcaaatgtcattacaaattatacaatactggaaggacacatcacatcagaaagcagcacaaaattaactggtgatgttgacgtcgatggatggacaatagtagtcacacgttcaaaagagaatttagagaacaaggatgcatgtgaaattacagcaaagaaaaaaacagatgcaaatcaaccaaccgatgtggagataccaaagacagaaaccaaaggtgtgcatgaagatagatccgtgcaaccaatacctgatgaaacattgattagcaacgaaacagttgctgagagtgatcaagatgagagacagccagaagcagaatttacagagaagattaacgatgaggtgaagactccacaaaacgatactttggagactgcagaaataaataaaaatgatactgagaaacaggaagaggttccagcatctcacgctgaggagaaacgagggattgaggatgatagcaaattcgatccagaagaagcaaaagggattgaagaaggaacacaaacacagttaccagaggaagaagtcaacacaacattgcccactgctgcctgtgtccaaggcgatactgatgaaataccgcagcagcaaacactgcaagatgattattcagaagtgattgatattgcaaagagcatcgacactccagaaattgaacttggcggaaggtccactgttgttgaggaacctgaacaacccgaaaatgtggacaacgtcggtgaggtgaaagaagaacaagcaggccaccaatcagaagaattgagtgtgtcgaatgtcagtacaaattatacaacaccggaaggacacatcacatcagaaagcaacacaaaattaactggtgatgtcgatgtcgatggacggacaatagtggtcacgcactcagaagagactttagacaacaaggatgattgcgaaattacagcagagaaagaaacagatgcaaatcaatcaactgatgtggatataccaaagacacaaaccgaaggtgtgcataaagataaatccctgcaaccaacacatgacgaagcatcaatcggaaacgaaacagttgctgagagtagtcgagatgagagacagccagaagcagaacttacagagaagattaacgaagacgtgaagtctccactaaatgatactgaggagactgcagaaataaacaaaaatgatactgagaaacagaaagagattcctgcatctcacaccgaggagaaactagggattgaggatgatggcaaatttgatcaagaagatgcaaaacagattgaacaagaaacaaaaacacagttaccagagaaagaagtcaagacaacattgcccactactgcctttgtccaaggcgatactgatcaaataccacagcagcaaacactgcatgatgatgattcagaagtgattgatattgcaaagaacattgacactccagaaattgaacttggcggatggtccactgttgtggaggaacccgaacaacccgaaaaaaccgacaacatcggcgtggtgaaagatgtaaaagcagaccaccaatttgaagaatctaacgtgttgaatggaagtacaaattatacaacaccgggaggacacatcacatcagaaagcagcaaaaactcaactggtgatgtggacatcgatgaacagataatagtagacacgtgctcagaagggaatttagagaacaagtatgcaagcgaaattacagcagagaaagaaacagatgcaaatcaattgaccgatgtggagataccaaagacagaaaccgaaggtgtacatgaagataaatccctccaaccaacacttgacgaaacatctattggaaacgaaatagttgttgagagtagtcaagatgagagagaggaagaagaggaattcacagaaaagttaaatgaagaggtgaagattccacaaaatgataccgaggagactggagaaataaacaccaatgatactgagaaacaggaagaggatcaagcatcacacgccaaggagaaactagggattgaggatgagggacaattatatcaagaagaagaaaaagggattaaagaagcaacagaaccacagttcccagaggaagaagtcaagataacattgcccactgctgcctttgtccaaggcgatactgatcaaataccgcagcaacaaacactgcacaatgatgaatcagaagcgattgatattgcaaagaaaatcgacactccagaaattgaacttgacagaaggtccactgttgttgaggaacctcaacaatctgaaaacaaggacaacgttggcgtgttggaagaagaacaagcagaccaccaatcagaacaatcgagcatttcgaatgtcagtacaaattatacaataccggaaggacacgccacatcagaaagcagcacaaaattaactggtgatgtcaacgccgatgaacaaacaatagtagacacacgctcagaagagaatttagagaacaaggacacaagagaaactacagcagagaaagaaacagatgcaaatcaatcgactgatgtggagataccaaagacagaaaccgaaggcatgcatgaagataattccctgcaaccaacacttgatgaagcatcgatcggaaacgaaacaattgctgagagtagtcaagatgagagacagacagaagaggaacttacagaaaagtttaacgaagaggtgaagactccacaaaatgataccgaggagactgcagaaataaacaccaatgaccctgagaaacaggaagaggatccagcatctcacgctgaggagaaactagggattgagaatgatggcaaattagatcaagaagaagcaaaagggattgaagaagcaacaaaaccgcagttcctagaggaagaagtcaagacaacattgcccactactgcctttgtccaaggcgatactgaccaaatacagcaccgacaaacactgcatgatgatgaatcagaagcgattgacattgcaaagaacatacacacactagaaaatgaacttggcagaaggtccactatcgttgaggaacctaaacaacccgaaaacaaagacaacatcggcgtggtgaaagaagaacaagcagacaaccaatcagaacaaatgagcatgtcgaatggaagtacaaattatacaataccggaaggacacgtcacatcagaaagcagcacaaaatcaactggtgatgtcgatgtcgatgaacggacaatagtagacacatgcttagaagagaacttagagaacaaggatgcatgtgaaatcacagcagggaaagcaacagatggatatcaatcaattgatgtggagataccaaagaaagaaatcggaggtgtgccagaagataaagccctgcaagcaatacctgacacagcatctatcggaaacaaagcacttgacgagagtagtcaagtggagagacagtcagaagcagaatttacagagaagtttaacgaagaagtgcagacaccaaaatatgatactgaggagactgcagaaataaacaccaccattgatactgagaaacaagaaggggttcctgcatctgaaggcaaggagaaactagggattgagcatgatgggaaacttgatcaagaagaagcaaaagggattgaagaagcaacaaaaatgcagttaccagaggaaaaggtgcagacaacattgcccactgctgcctttgtccaaggtgatgctgatcaaataccgcagcaacaaactctgcatgatgatgaatcagaagcgattaacattgccaagaacatatgcacaccagaaattgaactagacgaaaagtcaactgttgatgagcaatgtgaacaacctgaaaccaaggacaacatcggcatattaaaacaacaagcagaccaccaatcagtacaatcaagtgtgccaagtgtcattacaaattatgcaacagcagaaggacatgttaaatcaaaaagcagcacaaaattaactgatgatgtcaatgtcgatcaacagaaaactgtagactcatgctctaaaaagaatttagagaacaaggatacaagtgaaatttcagcaaagcaagcaatagatgccaaacaatctactgatgcggagatacctaagtcagaaactgaaggtgtgcttgaagataaagccttgcaaacaatacttgatgaagcattggtcaaaaatgaagcagttgatgaaagtagtccagaggatagacagctagaagcagaatttacagagaagtttaacgaagaggggcagacaccacaatatgatattaaggagactgcagaaataaacaccaccaatgctactgagaaacaggaagaggttcctgcatctaatgcaaaggaaaatgtaggggtcgaggacgatagcaaattcaatcaagaagaagccaaagggattgaagaagcaacaataaagcagttaccagttgaagaagtagagacaacattgcccactgattcctttgtccaaggtgatactgatcaaaaaccgaagcaacaaacactgcaccatgatgaatcagaagttattgatattgctcagaacatctacacaccagaaattgaactcgaccgaaagttcattgtggttgaggaacctgaacaacctgaaaccaaggacatcggcatagtaaaagaagaacaagcaaaccaccaatcacaagaatcaagcatgcagactgtcattacaagttatacaacagcagagggacacgtcacatcagaaagcaccacaaaattaactgatgatgtcaacatctatgaacagaaaacaataaacgcacgctcaatagaggatttagagaacagggatgcaagtgaaattacagcagagcaagtaagacataccaaacaatcgactgatggggagattccaaagtcagaaaccaaaggtgtgcctgaagataaagccttgcaaacaatacttgacgatgtaacggatggaaatgaagcagttgatcagagccgtcaagaggcgagacagccagaaccaaaatttacagaaaagtttaacgaagaggtgcagacaacaccatatgatactgaggagacttcagaaataaatgccactaatgatactgagaaacaagaaaaggttcaggcatctcacaccaaggagaaactagggattgaggatgatggcatattctatcaagaagaagcaaaagggattgaagaagcaacaaaaatgcagttactggaggaattagtccagacaacattgcccaccgttgcctctgtcgaaggtgatattgatcaaatttcgcagcaacaaacattgcatgatgatgaatcggaagcgattgataatgccaagagctgcatatcagaaattgaacccgacagaaaatctactgctgttgaggaacctgaacaacctgaaaccaagaccaacaccggcataccaatagaagaagaagcagaccatcaatcagaagaatcaagtgtggagagtctgattacaaattatataacagcagaaggacatgtgatatcagaaagcagcacaaaattaagagatgatgtcaacgtcaatcaacagaagagtgtagaatcaggcttggttgagtttttagagaacaaggatgcaggtcatatcagagtagaaggaacatattccaaacaattgactgatgcagagatacaaagttcagaaacagaaggtccacaagaggaagaagtccattcaaaattgcctgctgtaactgtacaaggtgaatctgatcaaaacttacagcaacaaacacttgatgatgatgaatcagaagcaatcaataatgccaagagatgcataccagaaaaagaacttgatagaatgtccactgttgttgaggaacctgaaaccaatgccaatgttggcatagtaaaagaagaacaatcagacaaccaatcgcaaggatcaagcatgcaaaatatgattgcaaattatataacagcagaaggacatctggcatcagaaagcaatacaaaattaaattatgatgtgaatgaacagaagatagtagactcacagtcagaagagaatttagagaacaaggatgcaagtaaaatcaccacagaggaagcaacagatgccaaacaattgactgatgttgagatacaaaaattagaaaccgatggtgtgcctgaaaataacgccatgcaaacattacccaacatagcattggtcagagtcgaagaagttcacgatagtaagcaagaagagatacaacgagatgcagaattttcagtgacatttacaaaaaagatgcagacaacacaatatgagtttgacgcaaaaaatggcattcctgaggcatatggggaaaaggacgatacatgccatctcaatgcagaaaacgaacagaaattagaatcccaaccagtagcacagaacaaggggactacattcataaatcatccgtatcaggatggagagactgcagaaatgaaccccactaatggtattgaggtagaaaagattccagcaaatcatgccaaggagaaactagtgattgaggatgatggtaaattcaatcaagaagaagcaaaagggatcgaagaagcaacaaaaacactgttactaaatactgcaacagagagcctaacagaggaagaagtccaggaaatattgcccactcctgcaattgtccaacgtgacacaaagcaaatcatgcaacaacaaacacttcacaatgatgaatcagaagcaattgataaggaaaagagctgcataccagaaaatgaacttgacagaaagttcattgctgttgaggaatctgatcaacctgaaaccaaggccaatgctggcatagtaaaagaagaacaagcagacaaccaatcacaagtatcaagcatgcagagtgtgattacaaactatataacagcagaaggacatctggcatcagaaagcagtacaaaattaagttttatgaatgaacagaagacagtagacgcgtcagtagagaatttagaaatcaaggatgcaagtgaaatcacagcagaggaagcaacagatgccaaacaattgactgatgaggagatacaaaaatcagaaaccgaaagtgtgtatgaagataaggccctgcaaacattacccagtacagcatctgtccgtattgaagttgagaaaagcattcaagagatacatacagaaacagaattagcagtgacagataccaaagaggggcagatatcagaaaatgagtctgaggcaaaaaaggaagtttctgagtatatgttaaaaaaggcttttgatctgcacaaagtggcatgccagaccggtgcagaaaatgaactgaaagctgaattcctatctgaagagcggagccaggaaactatagttacaaagcatccaaatttggaaggagagagcatagagataaacccaacaagtgaaactgaagaacatgaacaggtaccagcatcacacaccggagagaaattagagatcaacgatgatgggaatttcatacaagaggaagaaaaagagatggaaaaagaaactgaaaggcagttgcttaaaactgcaacagaaagtgtaccagaagatgaagtccagacaaccctgccaacatcaacaattgttaaaggtgagacagttgaaggaattgttcaggaacaaacactcgaggaagagaaatcagcagcaatagataacaatagtggcagaccagaaaataaacttgagggaatggctaatgttgttgagacaattgatcaacatgaatccatggccaaggtcagcactgaaaatgaagaacatgccaaccgccattctgaacagtctagcatggagaatgtaattacaaagcatatcaattcagaaggaatggtaacaacagaaaacagtacaaaatcaagttataatgtggaagaactggaaaaggttctagactcaaactccatagaaaattcagaaatgaaggatggtagaaaaatcttgtcagaggaagcatctaatatgaaagaagccactggtatggagttacagaagcctgaaatagaaaatgcacctgaggataaagccatctcaactttgcctgagatagttgaggaaagcattcaagaagtaatacaaaaggaagctgaatcagaagtgatcgataccaaagaggagcagagaccaggaaatgattttgtaaagaacatggaagttctcgagggatttgatttacacaaagcgcaaggcaacaccactctggaaaatgaaatgaaagcagaagtccagtctgaagcaaagagccgggagatcattatcgagcatcaaaatttgctggagactgcagaaataagtccaagaaatgatactaaagaacctgaaaaggaacataaagtcaccacaggtatctctgaatcagtatctgcagataccacagagcaaacagacacaggaaaaccggaaactccagaggccgaaatcactcaaccaggcatcacaaaagaagacgaagcaggagacgaattcgaaaaaataagcccatcatctagtgtgagtgtgatatccagagactctcaagacaccgacacgaaagtttcacacaaaaaatctcatggcatcctatcaggtgtagggtcaaaggtgaagcactcaatttccaaagtgaagaaggccattacaggcaagtcttcacaccccaagacaccaccatcatcaaaataaaaaaaaagtgacccattagacaactacatacatgctgcttttgtaaatagatagaatacacagatgcttgagctttttggagggcttgtttcttttgttgaggaattggattgatttgtttcattgatgtattgcttggtttgttatgaaaatttatcttaaggggggtctattattctcctaactcagtgtaatgtattcatattctctttgttttaatgaaattgttatagacataagcacaa

SEQ ID NO: 77 - DNA, 1006 bp, Glycine max
  misc_feature (1)..(1006): Glyma.11g110100.1
cacactgtacggtaacagagatcggagcgtggaacctctctctctctctctctctctgcggaaaccggaatatctcagttctctgatcagatccatccgacgtcgtttcagtgataatggctccgttcagcggcgatgagacggcaccgtttttcggcttccttggagccgcagctgccctcgtcttctcctgtatgggagctgcctatggcacagcgaagagtggcgttggcgtggcttcgatgggtgtgatgagaccagagctggtgatgaagtctattgtccctgttgttatggctggagttttgggtatttatggccttattattgctgttattatcagtactggcattaatcccaaggccaaatcttattacctctttgatggttatgcacatctctcctctggtcttgcctgtgggctggctggcctctctgctggcatggctattggtattgttggtgatgctggtgttagagccaatgcacagcagccaaagctttttgttggaatgattcttattctcatttttgctgaagctcttgctctctatggtctcattgttggtattatcctgtcttcacgtgctggtcagtctagagctgattaagaaagatgtggctgcaaaatattctttgatctaccatctgttttaaccttcttattgtgaaggcaaggggggtaaattgttagttgtgaggttaatgatgttgggataccacttgcaaggtttaacaaatgtgaaagcagttgctgcatcagtcatttttgtgtttgtataagtagtctttctttgcttaataaagctttttaagcttctttttccctatgtgccatataattcttaatcttcccttttttggctgctgccattgtaatttatatgtattaatgggtcttttagtattggatgctggtgtagcttaaacgttgccttgtgttctcaataaaagagcattttgagtattctaatattattttgaatgatgactaatgagattgttg

SEQ ID NO: 78 - DNA, 1782 bp, Glycine max
  misc_feature (1)..(1782): Glyma.09g030300.1
tctctctctctctctcacaagccacaatttcaacgccacaccaaaaattccactgcaccaccaccctccccatttgtacttttcttctcattctctttccactcccctgcattctgcacacaatctagctttacgtgcttctgggcaaccgcataaggttaaactgttaagcatatcattgaaatccttttgggattggaacttgatatgatcatttgtattggggagtaagaccttgttacttttgcaaatgctaaattttaataggatcagaagtcagcccaggacaaccagatctatgtctttgggaggcatggattacgtggatccaaaaaggaaaggcaattttgttggaaaagtttttcttgctgcagcattaacggcattatgcattatcatgatcaagagatctccatctttgaatcccccgagtccgttttccatccatgaaccaggtgtcactcatgttttagtgacaggaggtgcaggctatatcggctcacatgctaccctacgacttctgagggaaaattatcgtgtcaccatagtggataacctgtcacgaggaaatttgggtgctgtcagggttcttcaagacttatttccagaacctggaaggcttcaatttatatatgctgacttgggagataaagaatctgtaaataaaatattttcagagaataaatttgatgccgtgatgcactttgctgccgttgcatacgtgggagagagcacacttgaccctcttaagtattatcacaatattacatcgaataccttgttggtattggagtctatggctaaatatggtgtgaagacattaatatattctagtacgtgtgcaacatatggggaacctgaaaagatgcctattatagaaacaacagaacagaaaccaattaatccatacggaaaagccaagaagatggcagaagatatcatccttgatttttccaaaaattctaagatggcagtaatgattctgagatacttcaatgtgattggatcagacccagagggcagattgggtgaggctccaagacctgaacttcgtgaacatggccgaatttctggtgcctgctttgatgcagctcgtggtattacaactggcttaaaggttagaggaactgactacaagacaccggatggaacatgcatacgagactacattgatgtaactgatttggttgatgctcacgtgaaggctcttgagaaggcacaacctgctaaagtagggatctacaatgttggaactggaaagggtagatcagtgaaggagtttgtgaatgcttgcaaaaaggccacaggggtggacatcaaagtagactaccttccacgtcgacccggcgattatgccgaggtgtatagtgacccttctaagatcaacagggaactgaattggaccgcacaatacactgaccttgagaagagtttgcaggttgcatggaaatggcaaaaagctcatcgtaacggttacggtatttcatctgcaatctgagtttctagccattcagccaagcagttggccatcaactgctcttttacatggtgctcaggattttttttttctttttctttttggtcgtccttagggagtttggtagttgattcgttatacttacatgtgtattcaacatacaatgagtcaataataataaataatataatgcccagcctctggttggtatagcttttcttctatcttttggttcttgccaatgcagcattcacctcactagagcaaatgaaatgcaatcatgtatacagggaggggaattgatt

SEQ ID NO: 79 - DNA, 2257 bp, Glycine max
  misc_feature (1)..(2257): Glyma.06g115100.1
aaacctataatatataataaaaataattgacaggttgcttcgtgcggcaaatatattacaatcagagttattgcaatagcaataagtacattcgtgtctacctcaggtgctctaattctccaactgctatcatcagagtaaaactagaaaagataaacaaatttctgtcacctccatttttttaaagtattttttcaccacgtgtttaaattctcgtctttctctccccaccgtcttctctctcatcctttctcttccttctcccccgtctattttacgcccctcctctgttcttcgctctctccactctgtttccactgagagaaaaaaaaaaaaagcatgaagaaaatccgcaactcgatcctactcttatcattcgtgctggcagcctcggcggcggtttcatccgcagagcagattccttccgctgcttacgaccgcgtgctgttcccggaccgccggtgccagaagacggcgtcggagaacatgacgcggcgaggatcctctgcggcggcggcggagtgtgaggtgtggagtgagtcatgttcggaggcggtgctgagcgtggcgcggcggccggagacggcggagtggctgaagaagattcggcggaagattcacgcgaatccggagctggcgttcgaggaaatcgagacgagtggtttgataagagaagagttggatctgatggaagttagttatcgataccctctagccaagaccggtattcgagcctggatcggcacggggggtccgccttttgttgcgatcagagctgacatggacgcacttccaatccaggaagctgtggaatgggagtacaaatctaaagttgccggcaaaatgcatgcttgtgggcacgacgcacatgtggctatgcttatcggcgctgccaagattttgaaaactcgagagcatttattaaagggaactgtaattctgttattccagccagcagaggaagctggtaatggagcaaaaagaatgatgcaagatggtgctttggaggacgtggaggctatatttgcagctcatgtatcccatgaacatccaactggtataattggctcaaggcctggacccctccttgcaggttgtggattcttcagagctgtcattagtggcaaaaagggtcttgctgccaatcctcaccgttctgttgatccagttttggctgcttcagctgcagttatcagcttacagggtattgtctcccgcgaagcaaatccattggattctcaggttgtctctgtgacttcgtttaatggaggcaacaatcttgacatgatacctgactcggtggtcctattggggactttcagagcgttctctaacaccagcttttaccagctacttgaaagaatagagcaggtgattgtggaacaggctagtgtctacagatgcttggcagaagttgacttctttgaaaaggagtacacaatttaccctcccacggttaatgataaccgaatgtatgagcatgtgaaaaaggtgtccattgatttgctgggtcataagaatttcagggtagttccacctatgatgggtgctgaagatttctctttctactccgaggtggttccctcaggtttcttctacataggagtaaggaatgaaacactggggtctactcatacgggacactctccatatttcatgattgatgaagacgttctaccaataggtgctgctgctcatgctagtattgcagagaggtacctcattgaacatggttgatgttggaaaatagttgaaagaaccctgctcttgttgtcacgtcttctcaaattcgtacaaaattggtacacgagttcacccgtccccctcatgtttctcacacgagtaaattctcagtttagttcgtgatattgcaagtgtttgtcactttagttattaaattaataaaatctttactttagtctctacctttatataatcccattaactgtaaataacattttacaaagtcgaaagactaaattaaagatttcgagtggtcaaggattaaaataccaaacacttaaaagttaagtgactaaaatagaaatttactttcttatatctgttgcttgatgttaaggaacagtagagaccaggctatctttttatcctgttgagagtaggctcagaaaaaatagggaagcgccaaaatttgttcgaaggtggtttgaaacctgtttaactttgtggaggcaaggcaaatgtccaagagtataaagtataaacataccataaatattaaataataacttattaa

SEQ ID NO: 80 - DNA, 1901 bp, Glycine max
  misc_feature (1)..(1901): Glyma.04g014400.1
gttatttcagtttacatgtttatttatttcttaagatccgttgcaatttctgaatgatccaaaatcacatacaccatacgtaattcatatttcgaaggtgtgcttgtaataagtgtccagtgctaaattcatggccaccgccgccaccgaacctctcccttccaccaccgaaacgcctccggcaccgcctccaccgaagcaacccccgcctcccgcgccgcaacctccggcggcggcggcggcggcggcagtgaagccggaggctccattgcccgattcgaaaacttcggcggaggcgaacgtaatcgtggtgccgagctactctcggtggttctcgtgggattcgattgacgaatgcgaggcgcgtcacctccctgagttcttcgaatcggcgtccaagagccctagggtttacaagtactacaggaactccatcgtgaagtacttcaggtacaatcccacccgcaaaatcaccttcaccgatgtccgcaaaaccctcgtcggagacgtcggttccatccgcagagtcttcgatttcctcgaaacttggggtctcatcaattaccacccctcttcgtcgctcaccaaacccttgaagtgggacgacaaagagaccaaatccgattctgcatccaactccaccgaatcttcttccgctcccgtcaaagaaaacactaagagactctgcagtggctgcaaagtcgtttgtaccattgcttgttttgcctgtgacaagtatgatttgacactttgtgcgaggtgttatgttcgtggcaattatcgagttggtgtgaactcttcggattttaggcgagtggagataagtgaggagacaaagacggattggagtgaaaaggagatcacgaatcttctggaagctatttcgcattacggtgatgattggaagagggtttctcagcatgttcctggcagaactgagaaggagtgtgttgctcattttctgaagcttccttttgcgaatcaattccagcattatcaacaacaccctgctgtcaatggcacagatgacggttgtaatctgttaaagatggtaactaatgctgatgctgaatctgaattggatactgttgcctctgctgaacccagtaagagaatgcgtctcacgcctcttgcagatgcaagcaatcccattatggctcaggctgctttcctgtctgctttggctgggtcagaggttgcacaagctgctgctcaagctgcattgacaactctgtctgaggtttacaaagcaactaaaataaattatcgggcgtttccaaggaatacattgctgcaagatgctggtatcacgtctaacggtggtaatacttcagattcatttcaaggatctcgattgcatgcaaacatacagcttgagaaggaagagttagatgtggaaaaagcaatttctgagattatagaagttcagatgaaaaatatccaagataagcttgttcattttgaagatttggacctgctgatggaaaaagaaggccagcagatggagcaaatgaaaaatatgtttttccttgatcagcttactcttttatttcataaatcatctgcaccaaaaactggagaatgacaagaaggcaataatgtaaagacgaaccatggctgactactcttaattagctagtgatcttaggcttagcgaatgtattcaattatcctgctctctccatttgttttggccacgagtcactggactattagttcaatatcatacaactccatcttgatgtagagcgtcttttaacttttttttttataaccaattgtacatgcatttctagagtaatgcgttgtctgtatttgtagataaaatgtgatttttttttccaaacatacacaaaaaattaattatttaccaaaacatacatattcttccattatttacc

SEQ ID NO: 81 - DNA, 2130 bp, Glycine max
  misc_feature (1)..(2130): Glyma.17g017700.1
gaaaatcaagaaacggaagaatgatgaaatggatctgtggtttggttgcgatgtggtgtgaatcactgtccaatcccgttcgcgtgacccggccagccctataaactatatatcgtgaatcggattcagagagactgagagaaacgatgagggcagtgagtgcgttaatggtggctcggatgttgacgcgggaccactctctccctgtcctttgcagcgaaagcatacccttccgatcggtctggtggttcgtctatgccggcatctcatgtttcctcgtcctcttcgccggcatcatgtccggtctcaccctcggactcatgtctctgggtctcgtcgacctcgagattctcgagcggagtggttctcctgttgagaaaatgcaagctgcggtcatacttcctgtggttaaaaaacaacaccagcttcttgtcactctgcttctatgtaatgctgttgccatggaggctttgccgttatacctagataaactattcaatcagtttgttgctatcattctctctgtaactttcgttctatttttcggggaggttattccacaagcaatttgtagtagatatggtcttgctgtaggtgccaactttgcatggctagtgcggattttaatgattatctgttacccagtttcttatccagttggaaaggttctggatcacctattggggcataatgaggctttatttaggcgagctcagttaaaagcccttgtctccattcacagccaggaggctgggaaaggtggtgagcttacacatgatgaaacaacaattatcagtggagcactcgatttaactgagaagactgcagaggaggctatgactcctattgaatcaacattttctttggatgttaattcaaagttggattgggaagcaatgggaaaagttcttgctcgcgggcacagccgagttcctgtctattctggaaatccaaggaatattattgggcttctactggtcaaaagtcttcttactgtacgaccagaaacagagacacctgtcagtgctgtatccatccggagaattccacgggttccatcagatatgcctctctatgatatactaaatgagttccaaaagggaagtagtcatatggctgctgttgttaaggctaggggaaaaggcaaagaaactccacaaatcattgatgaagagaaaaatgaagaaaacgaaagcattggtggggattcacagttgaccactccattgctacagaagcaggatgcaaaatcaggaagtgttgttgttgacatagccaagccttcaaagccttccagcattaataagctgtctggtttgcaacgtagtgatggcacaacaaatggtccctcttcagaaaatattgaagatggtgaagtgattggcattatcactttggaagatgtatttgaagaacttctgcaagaagaaattgttgatgagacagatgaatatgtggatgttcataagagaatacgtgttgctgcagctgcagctgcttcctcagtggcccgagctccatcatcacgaaggttgactaaccagaagggagcaggaatccaaagtaagccagggcaagctcagaagaaatctgcagaggaaaatggattgaattctacaaagcaatgaggaaattcgtgttagcctgcaggataatgaacctttaagcaatgtgatgaaaaagaagccaaggagagttctttagtaatttgatcttatgatgtatcaaattaataactttcctttttggaagggcataaacggatgtattgctatttatataggtcatgaagccggtgcttcatgcatgctgcaattttatgttagataagtttttgttaaaatatttccgaaagtttcacacggttgggctgtgagatataacactgaggatgcagaagctgtgaaggtggcagaagaggcccaccaggacttgctggactggcttgctaaacatcacaagtgagacctattgttctgtcaaaactgtacaatggagtacttgagggaaggatgtaaaatgctactcaatcaacgtgcctgtagtttgcaagaaaataaatgttgtattattacctgttggaagtgaatcttatttctggatgatcctaataatgttgatttgagtttg

SEQ ID NO: 82 - DNA, 992 bp, Glycine max
  misc_feature (1)..(992): Glyma.17g030800.1
gcgttagtgaagaaagataagagagtagcattcctatttcctagctagtgtatactccacaacagtacacagctgacagcacccatttagtaaacgtgagtagtgactaccaaagtttatctttccatactccactccgttcactttttagactttcttcgccgtttgtggaagatgaggttgtgtctgtgtttaacgttgttgctggttctggctagtgtggcaatgggagaagaagatgcagatcataataagcactccctaaaagccaagtcacacgcgcagatccagtgcacaatgtgttcctcttgtaacaacccttgcaaccaagttccatctccaccaccaccatctccttcctccaacaactgtcctccaccaccctctcctccttcctccggcggcggaggcgaaggagctccgtactattactccccgcctccaccctctcagtatacctactcctcaccacctcctcccgcatccaccggcggaggaatgtactactacactcctcccagcaacagaaactacccaagaccgccgccgcctaacccgattgtgccgtattttccgttctactactacagccctctgccgcccgggtccactgcagctcctccgccctccacggcctcctcgattctctgtgcacttgctttctcatcttttctattgttgttgctttgatagtaaatgtaagaaaagaaaaaaaatgaaggaaaatggtaggaataacggcgcatatttgcagatctagagattctgagggaaatgagagggaggtagaactgtacaagtgcacgtgaatttcccaatctgccctgcacacgtgaactgaagtaccagtattatgttttctctctgaatttcttgtgccaatgtagattcatctgcaatttgttaataatttttatttttatgtactattaatactagtaagtcgtatttcgttagtataaaaataaaataaattacaaagatttatattt

SEQ ID NO: 83 - DNA, 4598 bp, Glycine max
  misc_feature (1)..(4598): Glyma.19g239700.1
gagtttgtcttgatgtttcctagaagtaggagaaagaataatcaagcaagctctcgtcctttccgttccatcaaaacttgccactttcttctctccctccctctacaacagggagggagtgtgtacggtcaactcttccataccaacaccctctccttcgttcccatgtcgtagtcgcggtgcaactcttgaatggataaagacaaactcctcgttgagtgcttatggaggaagaaaataagaagcaaaaatgaattacacttttcccatacactcaaactagcttatgcgtgaaaatgttgcaccgcgtctgggtggtggatttgtgaataggcaggagttgtttccctgtctatgtattgtcactagattgagagaactgctgtgattgggttttgatttcaactcactgatggagtgcaacaaggatgaggctttgagggctaggcagattgctgaaaataagatgcaagctggtgattttgaaggggggctgaaatttgctacaaaagcccaaaggctgtttcctgagattcagaacattcttcagatccttgctgtttgtgaggttcactgtgctgcacagaagacatactctgggtcagacatggactggtatggaattcttaagactgaaaagtccgccgatgaagcaaccataaagaaacagtataggaagcttgcactgctacttcatcctgacaaaaataaatctgctggtgcagaggctgctttcaagttgattggtgaagctaacagagtgttgagtgaccaaacgaagcgtgctttgtatgacttaaagtttggagttcctgtgggaaatacagcaactaaggtgccacctcgtcacccaaatggaaatgcttctgggatgggatgtgatggaactgcaagaaattgtcagaacagttatttttcacaataccaagcttggaatgcataccatcgggatgataatcagacattctggacatgttgccctcattgtaatactagatatcaatatgtcaaaaccattttaaatcataccatacgctgtcaacattgttctaaatcctttacagctcatgatatggggaaccacaatgtgccaccaggatactgggcaccatttaataaccagaaagagcctccaaaacatgcatcgtctaaagaagcatcaaaaggctatggtggaaaatcttctggtagagaacaggagggtgtatccatgtcaaaatgctcagctggtattggtgcccattctaaagttgcaaagagaagagatggtcatgtggctgcaggagtgacgaaggctggtgttgggacatccgaccccactaattccaaagccaaggaattgcgagcctcaacaaaggttggacataagagatcaaggcagtcagcatcagatgatgataagaaagctgcaaacggtaaagccgtgaaagataccaaggttcaagaaaatagggttgatcctaataggagatcttcaaggaaaaaacagcatgtttcgtacacagaaaatgataaagatggtaattttgggaattcttccaaaaagccaagacaccataaatccagtaacaataatccagcctcttttactgatggtgtgggtggtcagaatggagagataagaaataaagcaagtgcaccacctggagaaactattttaaggaataaaaccaaagttgagcagacaaatgtgcaaagaaaggaggcatccaactcagatcttaatgatagaaagtcaaaagctgacaattgttctccactcaagtcaaattttcctcccacttcagagatttgctgtcctgatccagatttcagtgattttgagagagataaggcagaggattgttttgctgttaatcaattatgggctatttttgacaataccgacagtatgccaagattctatgctcttgtcaagaaagtgtactcccctttcaaattgcggattacttggctggaacctgactcagatgaccaaggtgagattgactggcatgaagcaggtttgcctgttgcttgtggtaagttcaaactaggtcattctcagagaacttcagatcgctttatgttctctcatcagatgcattgcataaaaggaattgacactggtacttatctgatatatccaaagaagggagaaacttgggcaattttcagacattgggatcttggatggagttttgatccagaaaagcattcagagtatcaatttgaatatgtggaagttctatctgattttgataaaaatgttggcgttaaagttgcttatcttagcaaactaaaagggtttgttagtctctttcagcgaactgtgctaaacagaattagcttcttttgtattttgcctaatgagctatataagttctctcatcacattccttcatataagatgacaggtgctgaaaggcaagatgttccaagaggatcttttgaacttgatcctgctggtctgcctaatagtctttttgaagtcggtgatcctggtgttgtgaagatggatggtgtcaattgttcgcaccacgaatactcgaagtgtaaagttgaagaggcaatgcctaatgatagtattcacaaagcaacactgcgagagagtattgattctggaagagtagcacaaatcctcagaagatcaccaaggtcaagtaaaaaaagtatggacaatggtcaagcaagcactagtcaatatatagtcagaaaggatgacataaacattgtccacagggatgacagtccaccagagggaaacactgctgcatctcagactattaagaggaaggtcaagacacctcagaaacatgagaaaaataattatgaaggagaggcattgaaagctcgaaagtcacctaaagatttaggcaagaaaaatgctcaaggagatgcaggtgaatattcaagcaacagtaaaaatgtgaaggttagcaatattcctcagtcggtgggagcatcatgttatggctttaagaaggaaaaatctgaagagatgtttcggtgtggtcagatatgggcaatatatggtgatagggatcatatgcctgatacttatgctcaaattaggataattgaatgcactcctaattttcgattgcaggtgtacttacttgaaccctgctcaccaccaaatgacttaaaaagaacaacatcttgtggcacctttgcagttaaagaagccaaattacggatgctttctctctctgcattctctcatcaattaaaagctgaactcgtggcaaataatagatatgaaatttaccctagaaaaggtgagatttgggctctatacaaggaccagaactatgaacagacttcttcaaatcagggcagaggtgaatgtcatatagtagaagtattagcagataataacaagagtttccaagttgttgttctggtgccgcatggcagctctcagacaattttcaaggctcctagaattcagagatctaaaactggtgtaattgaaatattaagagaagaggttggcagattttcacatcagattcctgcttttcagcacagcgacaatgttcatctcagagggtgttgggagcttgatccttcatcagtacctggctgtttgataccaatagactgaagtatagcatttttatacccacttgtcctcttagttcgttgtagtgaacctaagttttcttatatgatataaccagctattctgtgaagcagcaaagtatggaaatgtgttcaagagatttcctcaatcattccatgtttattgatcagttgcattagttaaagcggctgttatcacattctggctatgttcttgttatcatcggtgtgtgctgatacgcgggacgcctgatcttgtgttgggacttggacgttccttaactgtgtctatgatcctgtttgctatgatatcccgagttcacctcaatttgataattttactatgccactcagccagaataaaaaaagtgataggacatcatgatcgggagaaacgtgatctatgctttgctggtaagtacattttcgtagcagcttgttaccgggaactacactatctgctttattgggcagttgggacaaggtaatgcatgttacaattgaaagttaaattttaaaataaggctatgcaaacgagaaaattaaaagacattagttttaattgttataattaaaaacaagatatacaaattatttaaaagaagataaaacaaaaatttaagtcattttgagataaatatgattttgtgtttagattattggtataattcaagtcaagacaagtgttgattaatattgcaggttagtaaaaggcaatgtattgagcagtagccagtaaggtgtaactatgttcaaaagcaatttctacgtttaacaaacgtactattgtttttatgaaacatgctgactggattttgaaatttcctagaagaaaattataaatttattgcgtcacccacattacaccaactcagcatagcgagttcattgttttcggtttttgcctcgactttgtttgggggaatactttgatatagtttgtgcttgaatgacattagcatcgtgtttggtcaaagtactttttattttattttaagtattgataataaatagttgagcaaatgctgctt

SEQ ID NO: 84 - DNA, 1097 bp, Glycine max
  misc_feature (1)..(1097): Glyma.15g209000.1
atacatttaaagagtaagttctctcatactcctctcactatacgttatccgagcgagatagagaacagatagagataacactaggcagcacaagagaatggcgctgctgtgtggttcaacttccgtgactccattcctttctcacaagaacgttggtttcacaacctcagcaaaatcttcctttgttggctttcaattgccgcttccaaagctcacattatcttcttccgttcgaacccttctgccggcaacatcccgtgtccgttgccagcaagagtctactactgttacccctgtcgcagaagaagacccgcgcttcgcgtgcgtcgaacccgaaccccgattcaaaggcccggacatttggaacaagagctggtatccaaaagctgcagatcatgtgaatacagaaaaaacatggtatgttgttgatgctacagacaaagttcttggaagactagcatcgacgattgctattcacatccgagggaaaaacttggcaacctacacacccagtgtggacatgggtgcgtttgtaattgtggtaaatgcagaaaaggttgctgtatctgggaaaaagaggacccaaaagctttacaggaggcactctggacgacctggtggtatgaccgtggagacatttgcccagctgcaaaacagaattcctgaaagaattattgaacacgctgttcgtggcatgcttccaaaaggaaggcttgggaggagactattcacccaccttaaggtttataaaggcccagatcatccacatgcggcgcagaagcccgttgagttgccaataagggataagagaatacatttgcagaaataggtcataggtgtagcagagaacatggaatgaaatatgaaaattttatgtctatctatttcacagaacttcgagtttcctgctttggttgctaccttgctgatgtttccattaaatgtttatattgtctgtagaggtaactgattattgtgttacttgtttttgtcaaggtcctttgtggaatcttcataatatttttgttgtagatttgaaccttgccatgcaatattttttaatatttgaatttattggcaactttttcatttgaagg

SEQ ID NO: 85 - DNA, 1119 bp, Glycine max
  misc_feature (1)..(1119): Glyma.19g217000.1
ggcggtgtttagacatgacaaccggtgcatggtgagaatagatcaagcttgcacgaagacattaaaaaatagaaatacatacatagctatggacaataatacttgtgcctcctcccaacttgagtcagaagaagcatcttttgagcacaaatcagaaactcaaacatcaaagaaaaggaaaatggttgagaaaacagttgtggcagtgaggacaggagagaatgttggcaagctgaagaatgaagggctaccttcggatttttggtcttggaggaaatatggacaaaaaccgatcaaagggtctccatatccaaggggctattacaagtgcagcacatccaaaggttgttccgccaaaaagcaagtagagagatgccgaactgatgcttcaatgctcataatcacatatacctctacacataaccatccatgccccactgccatcaccacaaattcaccccaacaaccaaaagaattatccgaatccgaaaccacccaagacctctcagctaccacaaaggaggaagaccaagaacatatagaactagaagaagagcaaagggataataataagcccagtgatgaagttacaaatgaagaaaattttcattacttgcaatctcctatacgttgctccggccaagacatcattatagaacaagaagatcctttcaaactaaacacggagaaaagccatgacagaatggatctcctcttagaggaagagcctctttgttttgcacagcttaagaacttgtctgcttccaaaaacgaagagcttgactttttcgatgagcttgaggagttacccatgtcttcatctttcttgcactttacgagaaacattttttccgatgaaaggattcccgttgccccttcttgattcaagtgttgttttctcggtgcttgctttgctagtttatgtattgttttcatccatgttatatatccattaatttcatctagtttttcaattcggaattttttctctttcttttgtaccctttatttatatgattatatcttatacttttattggttcacaactaagcatagttcatcactttggcatgagcagagttagtgtgtagacaaaatcatcagcttttgtagttaaag

SEQ ID NO: 86 - DNA, 1910 bp, Glycine max
  misc_feature (1)..(1910): Glyma.02g218100.1
aaaaatgtgaaagaattgtgctgttcatcactgttcatattacagtttcttgtagatattctgaattttgacttgcttcacttcacctcaacctcttccttgagtaaaaatggaaattgcataaagggcagtgtttttcttgagacgctttctttatattaaagtcgtatattttaatgcatgctgtcgagcttttgttactttgtgacaaatggagggtccttagttctgtttctctttcttctctctgtgctttcaaccaagttctcaaatcactcttcttcttcacccttctgatctgctaattctcaagatgttgttacttgttattgtttgataaggtattcaaaattgggtggttttcgattgaactgtgatgtccaagccactgctaggcatagcggaagaggaaggtcaaagcaatgtcactttgttggtttcttcctcagccaccatggaaagtgtgtgcctgaatagctcaaaactgaaagagcgcaactacatggggttatctgattgttcatctgtggacagctccgcgccgtccttctcagatgagactaagagcaatctgaacctcaaggctactgagctcagactggggcttccggggtcgcaatctcccgaacgagattcagatctttgcttgagaagttcgattcagtttgatgaaaagccactgtttcctttgcatcctgcaactgatgaacaccattcctcatcaaagcctgctgttttgggaaacaaaagagggttctcagatgtcatgagtggattcgccgaggagaaattgcttgttagttccgaggtcaacacaatattgccaccaaggccttcttctaatgtggggttgaaaccaagctctatgcttgagaacgtcggggctcagcagcaagccaaagaactcgcaacggtgaaggttggtcacgagaggtctcatgctgtcaacgaaagcagaccaaatcttaatgattctactaataacaatagcagtgcaccagctaccaaggcacaggttgttggttggcctcctataaggtcatttaggaagaattcattggtcactacttcaaagaatgttgaagaagtagatggaaaagtggggcctggtgcactgtttgtaaaggtcagtatggatggtgcaccttacttaagaaaagtagacttgaagaattacaatgcgtatgccgacctatcttctgcgctggagaatatgttcagttgttttaccataggttcttgtggatctcatggaaatctgggaggggaggtgctgaatgaaaccaagctgaaggatctgcttcatggatcagaatatgttcttacttacgaggataaagatggagactggatgctagtgggtgatgttccctgggagatgtttactgagacgtgcaagaggctaaggattatgaagagctctgaagccattggtctagcaccaagagctgttgaaaaaagtaagagcaggaactaggcagaattaagcatctcatcacacccttctatccatctaactgcttgtggggttaaaatgttttcttggctgtgtgagggagcaacacaaggccataatggcttggaagcacaacttaaggcatgtttggactggatagaatttggtactaaagctgccttgttgatcatgatattatttactatcggtgtgttctgttgtcatgatgtttatattcagtaagcttttttcatgattgtcacaacttataaaaccccaaaaacctgtctgtgggaggttcttatattttttatgtgctctcatgttcctgttgtggtgaaggatttgtagtttgtaaattggatcatctcttctatgtttgcaacttggtgtgataaaaaacaagaagttattatatatgtaatgcaccttctactgtttctcttttgtcaaa

SEQ ID NO: 87 - DNA, 1784 bp, Glycine max
  misc_feature (1)..(1784): Glyma.17g188600.1
tgcttcgccttaccttacattacaccctgtcatttttgcaaattctatatacattgcttttaactagtaaaaacttgttactttttggggactggtcgaactgctgtatgagtgagataatgattttcactcaacaattggtactaatgcaaaggttgttagtattcaggtttttatccatttgaccaaatatcttattttgcataactttgtttaagcagcagccatgtcttcttttcttcccgcctcagccgagtcacttgatctggcagtggaggccaaagacccgtctgagtccatctccattctttatcaggtacttgatgatccttcttcttctccagatgctctgcgcatgaaagagcaggccatcacaaacctcactgagcatctcagggaacagaatagggcagaggatttgcacagccttcttacacagttgaggcccttcttttccttgattcctaaggcaaaaactgcaaagatagtgaggggcataattgatactgttgcaaaaataccagggacttctgatctacaaattacactatgcaaagaaatgatgcaatggactcgtgctgaaaagcgtacctttctgaggcagcgagttgaggcaaggcttgcagcacttctgatggaaagtaaagattattctgaagctttgactctcctcagcggcctggtcaaagaggttagaagactagatgacaagcttctacttgtagacatagacttgcttgaaagcaagctacacttctccttaagaaaccttccaaaggcaaaagctgctctcacagctgcaagaacagctgcaaatgctatttatgttcctccagctcaacaaggtgccatagatctacagagtgggattcttcacgcagaggagaaggattacaaaactgcatatagttatttctttgaagcttttgagtctttcaatgctcttgatgaccccaaggctgtatttagcctgaaatacatgttgttatgcaagattatggtgagtcaagctgatgatgtggctggaatcatatcttctaaagctggcgtgcaatatcttgggcctgatttggatgctatgaaagccattgcagatgctcattctaagcgatctctgaagttattcgaaattgctttgcgagactacaaggctcagttggaggaagatccaattgtccacaggcacctgtcatccctgtatgattctctcatggagcagaacctttggagattgattgaaccatacgcaagggttgagattgcacacattgctgaactaattaaacttcctgttgatcacgtggagcaaaagttgtctcagatgattttggacaagaagttcgttgggacattggatcaaggagctggatgccttgtcatattcgatgatcccaagactgatgcaatatatcctgcaaccttagaaaccattttcaatattgggaaagttgtggacagtctttatgttaggtctgccaagatagtggcatgagcactccatctggtcacttcatttggtatttgctgcaatactatatgttctctttcacaattagtaggacacaagtcgtttgtttattttccaaatttgtaagactcgggacagtttttagcttctaaattcattgatccctaagccacttcaggggcctttattatttgtaattacaggcgtgttgatggtttgatctttgaaaaatagtaggaccatgcgtccttattataaggttcaattaattaacttatcaaaattaaggaaattgactaatttagtggagaatatt

SEQ ID NO: 88 - DNA, 2564 bp, Glycine max
  misc_feature (1)..(2564): Glyma.10g023300.1
cttttctttgccacctcttcagtcttcctcaacaatccaaaccccaaatagcataatcataatcctcaacctcagttttcatttcttatttagtacggtgcccactgaaattttacaacgtataaaatattaattatttatagccataaaatctacataactaaaataacactccaaaatattatttaattaactaccatctattattttttcagtccgaaaaatattcactattttttttaatatgctaagaaacattatgacaagtagcgggacaacattgaaaaggacaatgatggttgttttgttgaagcggggaggccaagtaaaacaacctcttatgcttgcgtctctgttctctcctctccactgtcttttcctctgctttcctctgtttttctctgttccatctttgagttgaaaacgatattatcagatatttctctccgtgttactcagcaacacaacttttgttttactcttcccctttgattgaattgtatcatcaaagtttctgtgcttatcaccttgagagtttcatagacgctgtatcgctatatggatgctgagtactctttcttctgtttctgatacgtgtgttttgggtctcttcaaattttggttttctctgtcactttggcttatccctcgggcttcttggattcttacccttcaggaagcttttccttgtctttcccttttttcacctaattgattttttttaaggtagaaattccgaattacaatatttcatttctaggatacaattgttttgggcaatgtccttcaatttaatatttttcaatccactcttattctccttgctttggttacctggatattcctaactaggctaattttatgtttcatgtgttgctcttaatttaacaccttttaatttatatttacttggtagaagaagaaaaaaaaaaggaaagaaatattttgttaccagagaaagaaaaaaaaaatccatttttgtcttccttaagttatccttcaccatgaaatttctcactttcccggtggatttgtgatatctgttcttttacttgagggtttctgtgtttgcgggtcacaagaaaaaaaaaatgaaggaaaagttggattccccagttacagtgcttgaggactatttcaggagctcagattcagaatcaagttcttccaaagagccttcagcggattctgagtctcaagagctttcaaaacctgcttctaggtggcattcatttattcaattgttgaggagcggatcgaagaaacagatgaacaacacattgcatcctctcagtgttctcaagctctccaaaagaatgagcactagcatgagggagtccattctcccaatttgtctcttagatgcaactgcttccccttgcaggtcaccttggaagatctttactcatcatgagattcaggttgcaaccaattcttttagccaagaaaatttgattgggaagggtggttatgctgaagtttacaaagggtgtttgccaaatcgtcaattagtggcaattaaacgtttaacaagaggaacagctgatgaaatcataggggatttcttatcagaacttggcgtaatggcgcatgtaaaccatacaaatactgctaagctggttggttatggagtggatggtggaatgtatctggttcttgaattgtctgaaaaagggagccttgcttcagttctttatggttcgaaggaaaaactaccgtggtgtattagacacaaaattgcattaggaacagcaaagggtatattatatcttcatgagggatgtcaaagaagaattatccacagggatataaaagctgccaatatattgctcacgaaggactttgagcctcagatttgtgatttcgggctagcaaaatggctaccagaaaattggactcatcacaccgtttcaaaatttgaaggaactttcggttacctagctcctgaatacttgctgcatggcatagtagacgagaaaacggacgtatttgcatttggtgtattgctattagaattagtgagtgggcgaagagcacttgattattcacagcaaagccttgtgttgtgggcaaaaccattgctgaaaaaaaatgatattatggagctggttgatccttcactagcaggtgatttcgactctaggcaaatgaatcttatgctcttggctgcttcactatgcatacaacagtcttcaattcgtcgtccctctataagacaggttgtacagcttctgaatgggaaccttagctgcttcaagggcatgaagaaaactcgaatgccattcttcagaagagtgttcagggaagaactacatgattctgattagtttgaaaggaacaggaggcacatgatcactgaatggtgaaggtgatcccttctttctggggggagtttcagcagctagaaattgcctcatcaaactgaaaattttgcactttgttgagcccaaaatatgaagcattttaaactattcaacttttgtacataatagtttttcttttatatatatataaaatgttaattgttagatttttgtgggacagatcaaacttatcacttttct

SEQ ID NO: 89 - DNA, 5177 bp, Glycine max
  misc_feature (1)..(5177): Glyma.18g280500.1
aaaagcacaaaagaagagagagacagagagaaagagaaccgtttgagaattttagagacgttatcggatttcaaatccacaattcgccggaatttgggaaccgcggttgcgtccggagcctcggttagtagttagttagggtttcttttttctctttcttctcttccattcggtttcaaattttcgcgattagcgatggaggaacgaggctgaggccgaatttcaaggttctggtttcgtcgtcgctgtggagtgaagaattctgtgctgctgctggtggtgatgtttacgccgcagagggtttggtcgggctggtccctgacttcgaacaggagcggggttcggggcggaaccgggtcgggttccgatttgggtccgaattcgggagatggagcgagcacgaagggaaaaggtgtcgcgcttgttgagaatggtgggaacttggatcgcgaagttttggttgagagggtttccagcctcgagaaagagctttatgagtaccaattcaatatgggactgctcttgattgagaaaaaagagtggaattctaagtatactgaactaagtcaagatttagtagaagtgaaggatgctctagatcgagaaaaagctgctcatttaattgctctatccgaggcagagaagcgagaagagaatctgaggaaggccttgggtgttgagaaagagtgtgtgcttgatcttgagaaggctctgcgagaaatgcggtcagagcatgccaaaattaaatttacagcggactcaaagttggctgaagcaaatgctttagtagctagcatcgaagagaagtctttagaagtagaagccaaattacgttctgctgatgccaaatttgcagaaatcagcagaaagagttcagagtttgataggaaatcactagaccttgagtctcaagaatctgcacttcgaagggatcgattatccttcattgcagagcaagaagcacatgagagtacattgtctaagcagagagaggacttgcgggaatgggaaaagaaactacaggagggtgaagagaggctggccaagggtcaaagaattatcaacgaaagagagcaaagggctaatgagaatgacagactatgcagacagaaagaaaaggaccttgaagaggcacagaagaagattgatgcaactaatgtaacactgagaaataaagaagatgatgtgaacaataggtttgcgaatattactctaaaagagaaggaatatgattctctgagaataaacttggatatcaaagagaaggagttatctgcatgggaggaaaagctcaatgctagagaaaaagttgagatgcagaaacttcttgatgaacaaaatactattcttgatgtgaagaagcaggagtttgaggtggaattggatgagaaaagaaaatcctttgaagatggattgaagaataaattggtggaagtggaaaagaaggaggctgaaatcactcacgcggaggagaaagttgtgaaacgggaacaagccttgggaaagaaagcagagaagcttaaagagaaagaaatagagtatgaacaaaaagtcaaagctttgaaggaaaaggagaagttaattaaatctgaggaaaaaagtttggaaactgagaaaaggaaaatagaaagtgagagagaggaattgctcacacataaggctgaagttgagaaaataagagctaacaatgaagaagagttgttgaggataaatgaagagattgatcgacttaaagtgactgaggaggagaggtctgaatatctgcgcttgcagtctcaattgaagcatgaagttgatcagtacagacaccagaaagagctacttctgaaggaagctgaagacttaaggcaacagaaagagacttttgaaagagaatgggatgagctagatctgaagagaacagatgttgagaaagagctgaaaagtgtggttcaacagaaagaagaactattaaaactacaacaatatgaagaagaaaagttaaagaatgagaagcaggacacacaggcgtatgtgcaaagggagttagaaactcttaagttggctaaagagtcatttgctgcagaaatggagttggagaagtcaagcctagctgaaaaagctctaagtgagagaaaccaaatgcttctggattttgagctgcagaaaaaggaacttgaagctgatatgcataatcagttagagcagaaggaaaaagatttgatagagagaaagaagttatttgaggaaaaaagagagagtgaattaaacaatattaacttcttgagagaagtagctaatagagaaatggatgaaatgaagcttcaaagaagcaagtcagagaaggagaaacaagaagctgatgagaataaaaagcatcttgaaaggcaaaggatggaaatgcaagaggacatagatgtacttgttgacctcaacaggaagctgaaaaatcagcgggaagaatttattgtggaaagacgacgctttattgagtttgttgagaaacttcggagttgccagaactgtggggaaatgatctctgaatttgtgctttctgatttacaatcctctgttgacattgagaacttagaagtgccttctcatccaaaattagcagctgatattgtacagggagtttctaacgaaaatttagcttcttcaaggcaaaatactggagtgtctcctgcaactgatcctaagtcacctgtttctggtggcactgtctcttggctacgtaaatgcacctctaagatttttaaaatctccccaattaggaagattgaatctgaagattctggtactttaagagatgttgtgactttgtctgttgagaaaactaatgtggaagattcaccaggaagaattcctgatgctgaaaatgaagcagagttgtcatttgctgttgtaaatgattcttttgatgttcagagggtacaatctggcaatgatatcgtcgaggttgaagctgaccatgaaccttcagttgaaaacctgaacaatgttgacagtaaggcaccagaagatttgcaggctcctgattcaaaggttgggcagcagaaatcccgcaagggagggggaagacccagagtaaagcgtacgcacactgtgaaagctgtcatcaaagaggccaggggtatacttggggaatctgctgaagcattacctggggaatctgtggatgatcatgagaatgagtttccaaatggaaatgctgaggattctgccaatgtgaattctgaaagtcagaaaccatccaatagaagaataccagcgaatgtcaggaagcgaaaccgggttcaaacatcatctcaaatgactgtaagtgggcatggtggcgatgccagtgaaggacattctgatagtctaattccaggacagcgcaagagaaggcgacagaaggctgctgctccccccgcacaaactgctggtgaatcaagatataatttgagacgacccaaaattggagcaacaacttcatctgttagagctatgtctggtggtggcaaagaaagtcagggagaggttgatcgtgtaaaagatacaggagaggggattgttgactcaaaaacttctcattcacattcggtgggcattactaatgagaatggtggaagcatacatcttgagcagtctctgaaaggtgcggagacaagggacggttatggtggtgataccatcgggacctttgtcaacaatatggccttgagtgaggaggtgaacggaacagcagatgatgtggaggagaatgatgctgagtataggagtgaatcccatggggaagatgctgctggtggagttgagaatgaggatgacgaagattacctgcaacccggtgaagcttcaatagggaagaagctttggaatttttttacaacataacaccacaagcttcttgataatgaagctgtgtcttgacctcatcaactttagggatgatgtcggaagtttatcttgtattaacaattggaagtagatctctaaattataaccacgaggggtagtacttaggagaggtgattgaatttctctagttttttttttcttgtacgttttcatggatgtttggatggaacctctggtatttgttgatagttttaggcattctcgatagtgtagctaaagtttagatattggattttagctacctccccttggaaattgattgaatccaaatgtttgtatctcttctgctaaatgtgattgtttgaatttaatgagggtgcttgtgtatcccgttgtgtgaactactacgggtggcaatttgggtttgcgagttgagcgtgtcaaggagtgggtaattccaactgagcacactaattattttaagaaaatatataattgtccttcataaaatttggattatcatggcttttgatgctcatatatagttataacataatacagagttacgcagattcatgatacaaaattacaaatggtgcggctgacattgattagagaagtgctaggtaacacaattgaggacacgccaatatttgtcgccggctttgcaaacctctcattggagactataggattttttgttcatgtttgttctaataagaacttctttgcattggaaaacaatggtcgcattgattggaattggagctcaccacaaaaacaacaaatgcattgttagttgttacggctgggctacggtgcatgaaggtcatgggaagatgcactaagtagaaagggtgtagatagcactattagcagatgaatgagagaaaagaaagaatttatggaaagaaaagctgacaaattagagcagaaccaaggattacaaaagggtgcactaaactaaatttatacatgtcttttccaattaactctaagtggatgctttattaggtgaaagtatcccttgctatgactcttccccaagtgtactaaactaaattatgtataaaaggttctctcaaatttatacgtgtcatacttgtttgtgtttcaaaaagagaagataaagcttaatttgttattgtgtacgtagcaggcacagttgcccttgaattaggcactcagggttgaaacatttcaatatttatagacttgttctgtacagtggtatatggaattagcagtatttgcaattctgtagtggcccaagacttagtaagacgggttggatgttattgtgtcattgtcaaacgagatacactcaaagaatttcagaaaataagatttcttac

SEQ ID NO: 90 - DNA, 2651 bp, Glycine max
  misc_feature (1)..(2651): Glyma.02g165800.1
ggagaaagcaagagagagcgaatcgcgtttacgcaaccccgggacgcgaggaacaccaacagcagcaacccgctactgctgcagtgtggtggcagttgccatgcttgcaagttagaaagaaagaaacagtgctcgctcgaatttcgagaacgaaagagaggaagaaaaaatgtacagcagtggtggcgctgaagccgaatcggaatctgaatctgagcgcaatagaatgggtgatgataaggaagaacagggctcctcgttcaagagctgggccaaacaaacggaggagagttatcagctgcagctcgctcttgctcttcgtctttcttctcattcagcttcttcttcggatcacccctcttcttcggcccagacgctcacgcaccggttttgggtagatggttgtttgcaatactctgataaaattatagatggattctacttaatccatgggatggatgtatatacatggactataagtactgatctgcagaatgttggtatgattccgtcatttgaatcactgatgtcaattgaacctagcgatgacttgtcaatcctagtggttgctgttgataaatctagagatcctggtttgagagaactgcaaaatagggtagcaagtctttcaaataactggattaccacgaaagatgcaactgatcagcttgcaaatcttgtttgcaataggatggggggaggatctttaactgaggaaaatttaggtacacgctggaaggaatgcacccaacttcttaaaagctgcctgcattccgtcattcttccaattggaagcttacccattggcctttgtgtccatcgagctttgctgtttaaagtgttggctgacttaatcaatctaccatgccgtattgcaaagggctgcaagtattgtaggaaggatgtgggtgcctcatgtatagtgcaatttggttctgacagggagtatatgattgatttagttggaagacctggggcaacatgccagcctgattcttcactgaattctgcatcttcaatgttggtcccttcaccattatgtcatccaaagttcaagccagttgaaacagctgaatatacaaagacactagcccaattgtatttcttggacagtgaagcactgcatcttgtatttgataccacatcaggacctgctgttaatcatagtggcagaatggatctacagaaaactgaagctctgggtgcaaattatgcgggtgggaacagccatctgattgctttgattcctggtgcagaggaatatgagtctttcaatgaagcaaaccagtcaataatggattacccaagtcatgaagttgatcttgacaaggaggatctggatattccatggagtgaacttattttgaaggagaacattgggacagggtcatttggaaccgtccttcgtgcggactggcgcggttctgatgttgctgtgaagattcttaaagtgcagggttttgatcctgggcgatttgaagaatttctaaaggaggtctcactcatgaagcgcctccggcatccaaacatagtacttttgatgggtgcagttattcaacccccgaagttatcaatagtaacagaatatttatcaagaggcagtttgtatgaacttctgcacatgcccaatgttggatcatcacttagtgaaaagcgtcgtttaagtatggcttatgatgttgcaagcggaatgaattatcttcatcaaatgagacctcctattgttcatagagatttgaagtctccaaatcttttggttgatgattcatacactgttaaggtatgtgattttggcctttcacgtacaaaggcaaacacatttctttcatctaaaaccgctgccggaactcctgaatggatggcacctgaagtcattcgaggagaactgtcaagcgaaaaatgtgatgtattcagctttggtgtaatcttgtgggaactagtgaccctgcaacagccatggagacaattaaatccttcacaggttgttgcagctgttggttttatgggcaaaaggctagagattccagggcatgtgaatcctcaagtggctgccttgattgagctctgctgggccacggaacactggagacgaccttctttctcctatgttatgaaatgtttgcagcaaataattgctgatgctaaagggtgaacaagtttaccctgataatcttcaacctgtatacagacaagaaacagcaatattgaacagaaaaataaatgggattccagtttattcaggaaattgctgaagaattacaatataccgttttatagagtaacctacgaatttttgttgtatatgctatttatataatcattactcacattgtcatatatattactatttgctttggatgtacctataataatcgtatgacactgggattctaatttatacatataagaattatttttatcttttaaaagaaataataataaagtttcctttccccccatcattgttattacactaggaaggataactgtacatgaacacccactaacattgcaattctgcactcgcaacccatttttgtaacatcccattattattattaccatctcagctatatttttatctttgcttaaatagttattgaagtttacattaatttattttgcgagcatgttaaccgaataagtatttt

SEQ ID NO: 91 - DNA, 1155 bp, Glycine max
  misc_feature (1)..(1155): Glyma.20g162200.1
ctaatagttaccgttgaaacccattgcgttcatttaaagatgcggcttgtgccaaagccaattttcaaagcgatcaacgaatagagaaagaaagaaagcgaaatcaaattgttagagaaacgcgagttaatccagaaatcaaagaaagcgttacttgacgttcgtttgaacattaacaacattaacacaaatggcaacacgaactggtcgcttgtttcaaaatcaaaacctgaatgtccacgttaatggaggaggaactgtttctgagaaggctgatttaacaggacagaggaaagttagggctgggggaagaaaaccacttggagatctatccaatgcagggaacctcatcaaccattttgatggaaagaaaggccttgatggttcattgtacacgggcaaaccctctgttagtcaggcacaggcaccgaaattgcacaagtcaaagaatcttgaaagtgacaaaagaattccagcttctgagaaatcactcactcgtagcaggaaagcactttctgacatttcaaactcagggaagccacaggttcctgagataaaaaataagaagaccctgaaaccattagaggaatctcttcctcccagtgcaatttctgaagaacaaatcttgcacgatcataagaaatgtatcaaatcacagtttgaaactgcagatgtgcatcagttttttaagactgttggacttgaggatgatgatcacatggcaatttcctttgagctgtctgcaattagtaaacagaagtctgagagtgcatatttggagttggaggaggtacctgagtggttgcctgaagtgcactctctatctgttctgcatggtggttccccagcagtacactgcaagactccaggcttgtcaagttacagaacaatgtggaatgactctactgtcaatttcaagttgatagagacaccaaaattgtccaaaaaatgatttttcccgcaacaatgtaaagaacttgatatggtgagtagtagattttgtgccacagataatgatcgttttttcggtagacatgttttgttcatcttagacatattttgtgccactgatggtgttggctcctatgtttctattgctgatttcgtcatgacaattaaaaggtactttcgctaaaatcattgttaataccgagt

SEQ ID NO: 92 - DNA, 726 bp, Glycine max
  misc_feature (1)..(726): Glyma.16g036900.1
atgaccaaaccccaaagtttaggtgctagtgaagtgagtgagcgagcaagtgaggctccgcagccactttcccaacccaaaacctctcttcagcccataaccatcatgtatctcccccgccaccacatcctcaccagactctccccttaccgccgtcacttctcccactccgccgccgccgtcctccgccccccggagccggagcccctcacctacctcgacggcttccctcgccccgatcccaagcacgacgagaccatcctcgccgtcccccgcgccgactccggcaagaacatctccgcgaaggagcgccgcgcagggcgcctgccgagcatcgtgttcgagcaggaagacggccagcacggcggcaacaagcgcctaatctccgttcgcaccgaccagatcagaaaactcgtcaaccacctcggccgctccttcttcctctcccgcctcttcctcctcgaagttcgctccggcttcgactccgaaaacgacgtcgtcgagaccgttcgcgtcttaccccgcgcgattcatttgaaagctgggacggatgcgccgttgaatgtgacttttattagggctccgtcggatgctttgttgaaagttgatgttcctcttgtcttcagaggagaagatgtatcgcctggactcaagaaaggtctatccacttggccagggaagtcttcgggtcataggttgaacttgatgcttgtaggtttcatgtga

SEQ ID NO: 93 - DNA, 4895 bp, Glycine max
  misc_feature (1)..(4895): Glyma.15g271800.1
aagggagaagccgcctcagccagccactgcttctcgctctgtgaaacctcaaaaccttctaaaaccccttttcctatttctatgcatcttctccttcttatctaatccgtacttcacctttaattgcttaagtcctattctcgctgaaggaggaaatggctggaaaatcgggcaaggggaggaacagaaaagggtcccataatgcgtccagtgcttcagaacctccagtccattccaatgttcctgtgaaggataatgtggaagtcactttggaatcagcaaaaactgatgcagctgatgctgcaggcaactctactgttgccaatcccgaggtgaaggagaatgaaacaacaactgaagggagccaacaaaagcagggtgatcttcaactttaccctgtttctgttaaaacccaaactggggagaagcttgagcttcagttgaatcctggagactctgtcatggatgttagacagttcctccttgatgctcctgagacatgttttattacatgctatgatttacttttgcatacgaaggatggatccactcatcacctggaagattataatgaaatttctgaagtagctgatattactactggtggctgctccttggaaatggttcctgcattttatgatgatcgatctataagggcccatgttcatcgtacaagggagttgctttccctttctaacctccatgcttcactatcgacatcacttgccctacagaatgagatagcacaaaataaaggtgcaaattcaggagataccttgaaacctgaagttcctgagcttgatgggcttggttatatggaggacatctctggttcattgggtaatttattatcgtccccattgaaggatattaaatgtgttgagagcatagtgttttcatcctttaatcctcctccgagctatagaaggcttgttggagatttaatttatttggatgtggtcactcttgagggaaacaaattttgcattacggggagtacaaaaatgttttatgtcaactcaagctcagcaaacaatcttgacccaaggccaagtaaagctacttttgaagcaacaactcttgttgctctcttacagaagattagccccaagttcaaaaaagctttccgtgaagtattggagggtagagcagctgcccatccttttgaaaatgtgcaatctttgttgccacctaattcttggcttggattataccctgttcctgaccacagacgtgatgcagccagggctgagaatgctttgactcttctttatggcaatgagccaattggcatgcaaagagactggaatgaagagctgcagtcttgtagagaatttcctcatacatctcctcaggagaggattttgcgggatagggcactttataaagtgacatcagactttgttgatgcagctattaatggtgctattggagtgatcagtggttgcattcctccgataaacccaactgaccctgaatgctttcacatgtatgtgcacaacaatatattctttagttttgctattgatgctgaccttgagaagctgccaaagaaacgtgtggatgctaattcaaaatcttggagctccagcactttgcaaagttcttctgataaagattccattccacttcatggagaaagtcaggttcctaatgggggtaaagatgacagttcaagttcagaagatcttaatggcacagaaattactcaagatgtttctccagaagctcagctggctgagaatgagcaagccacatatgcttctgcaaacaatgatttgaagggcacaaaggcttaccaagaagctgatgttcctggactttataatcttgctatggctataattgactacaggggtcatagagtggtagctcagagtgtcttaccaggcattcttcaaggggacaagtcagactctctcttgtatggctctgttgacaatggaaagaaaatttgctggaatgaagattttcattctaaggtgtcagaggctgccaaatgccttcatttgaaggaacatttagtccttgatggatctggaaatcttttcaaattagctgcaccagtggaatgcaagggcattgttggtggtgatgaccgacattatcttcttgatttgttgagagtaactcctcgtgatgccaactatactggacctggttcccgattttgtatcttgagaccagaattaattactgcctattgccaggcccaagcagcagaggcattgaaatctaaggagaagaattttcaagaggcaaacagtttggccactgaatcccaaaatgctgctgaagctgaccagctggtaaatgattcccaaaatgctgctgatgctgacaagctggattcaacaaaggaagaaaaagctgaggatgttaaagagcttgcttctgtgattgccaaagcctctgatggttgtgaggatattgtttttaatcctaatgtcttcactgaattcaaacttgctgggagtccagaggaaatagcagctgatgaagataatgttagaaaagttagtcaatatcttacagatgtggtacttccaaagtttatacaagacctatgtacacttgaagtttcgccaatggatggccagacattaactgaagcattgcatgctcatggaattaatgttcgttatattggcagagtggctggggggactaaacatctacctcatctgtgggatctttgtaatagtgagattgttgtcagatctgctaagcatattatcaaggatttattgagagagacagaggaccatgatcttgcaccagcagtatctcatttcttaaattgcctatttggaagttgtcaagctcccagtggaaaagttcctgctaatagcacgcagtccaacactcctaaaaaggaacatgcagggcaacggtctccagggaaacattccaaagggctagctcggtggaaaggcagggcatctttaagaaagactcaacctttgtatgcaagtatcagctcggaagctctttggttagacattcaagaatttgcaatggttaaatataagtttgaattgccagcagatgctaggtcgcgtgtcaagaaaatttctcttatacgtaatctctgtctgaaggttggtataactgttgcagctcgtaaatatgatcttagttctgcaactcccttccaaacatcagatgtcttagatctccgtccggttgtcaagcattcagttcctgcctgttcagaagccaaggaacttgtggaaactggaaaacttcaattggctgagggcatgctcagtgaagcctacactttattctccgaggcattctcgattctacaacaggtgactggtcccatgcatcgggaggttgctaattgctgtcggtatcttgccatggttttgtatcatgctggagatatggctggggctattatgcaacaacacaaggagctaattataaatgaacgttgtcttggtctagatcatcctgacactgctcacagttatggaaatatggctctgttctaccatggccttaaccagacagaacttgcacttcgccatatgtcccgtgcttttctattattaagtttgtcatcggggccagatcatcctgatgttgcagcaacatttatcaatgttgcaatgatgtatcaggatataggaaagatgaacacagctcttcgttatctgcaagaagctttaaagaagaatgaaaggcttcttggcgaggaacatattcaaactgctgtttgttatcatgctctggctattgcatttaattgtatgggtgctttcaagctctctcaccagcatgagaagaaaacatatgatatacttgtcaaacaacttggtgaagatgattcaaggacacgggattcgcagaattggatgaacacatttaagatgcgtgagctgcagatgaatgctcaaaagcaaaagggtcaaactctgaatgcagcttcagctcagaaggctattgatatcttgaaggctcatcccgatttgatgcatgcattccaagctgccgcaattgctggaggatctggaagttcaggtgcatctgctaacaaatccctcaatgctgcagtaatgggtgaggcactttccagaggaaggggaattgatgaaagagctgcacgtgcagctgccgaagtcaggaaaaaggctgcagcaaggggcctgtcggttcgtccccacggtgtaccagtccaatccttgccaccccttacccaacttctgaatattataaattcaggtgtgactccagatgcagtggacaatgggaatgcagacggagcaaagaaggaagcaaatgacattcctccaagtgattcaattgatgccaagaaaggccaaacaatgcctgtgcaagaacaggaacatgctccagttggatcacattctccggttggactaggcaagggcttgtcatcattggatgctaagaaacaaaaatcgaaaccaaaggctggggcttgaaattttgaactgtaagctctggtagttggcaatggtagatttatttgagatcaaatattctttgtgagatggttggattgaccagtactttgctcagttttttttttttgaagagtgttgtagcgatcagaaataattttggcgcctttttttgtcctttctctgtagatttggtagatttaaatatccacatggaatgcaagtgacagtgatcaagtgcattttttgtctggtcaattactgataatctttcagtaaattatatatttggggatatagggtaacgacgatcattttgataacgaacccttgcatctgtaacaaatttaattgatgctgaattgaggcaaattcaatgcataatctatcctgtagaattttttgctgcaatttttgtatgacattattatcattaataaaatgttggtattgtctgtg

SEQ ID NO: 94 - DNA, 1901 bp, Glycine max
  misc_feature (1)..(1901): Glyma.11g222900.1
atgttgcgtttttgtgttatgaaataatgttgttaccttcctctctctaacctgcaatttaacaactccttcgtttcttctttcttttttctaaaacctcaaaaccaaaaacacaacacaactttcgtaacgtgtctctcccttcttcccctcctctctccggttccctaattctgccctcactgcacccaattccaattcccctcacccccaattcggggaattagggtttcgccccattcattcatcgatgcaccaccaccatcgtcgctagggtttgcttcgatggcggaattggaggaggagcggatgggaggggatttcaagcccttctcggagggctcttcgtgctcgcgttcgatcagcgaaaccgtgaacggctcgcaccaattcacaataaagggttactctttggccaaagggatgggcgcgggaaagtacatcatgagcgacactttcaccgttggtggttacgattgggctatttacttctaccctgatgggaagaaccctgaggacaattccatgtacgtttcggtctttattgcgctcgctagcgacggaaccgatgttagggctctcttcaagttgacgctggtggaccagagtgagaaggggaatgataaagttcatagccatttcgatcgccctctagagagtggaccttataccttgaagtataaaggcagcatgtggggttacaaacgcttcttcagaagatcactactggaaaattcactgtatctaaaaaatgattgccttgtcatgcattgcactgttggggtcgttaaaactcgttttgagggatctaaacagggtgttatcgtgccacagtcagacatgggccgagattttaaggacttgttggaatctgaggttggttgtgacatagttttcaaggtcaaaagtgaaagcttcaaagctcataagttgatacttgcagcccgatctcctgtgtttagagcgcagttttttgggcttgttggggatcctaccttagaggaagtagtggtagaggatattgagccctttatcttcaaggcaatgcttctcttcatctactctgacaaacttcctggcatatatgaggttatggactcgatgcccctgtgctcatacactgtcatggtgcagcatctcttggctgctgctgatctctataatcttgatcggctcaaactgctttgtgaatcaaaattatgtgaagaaatcaatactgacaatgtggccacaacacttgcgctggcagagcaacaccactgtccacagcttaaggcaatctgtttaaaatttattgcaaatcctgcaaacttgggagctgtaatgcagtcggaagcttttgtgcatttgaaagagagctgcccctcaatgctgttggaattgctggagacatttgcatcagtggatgataactcaggccagacattaagcagaaagagaagtggcagtagcatatatggtcaagatttagcagatggggcagctgctgaatcagttaatccgaatggcaggcgagtaaggaggcggacataagcatagtttacaatctgaatatgcaaccgttgaaagtgtgatatagataacccacactagtcctgttaatataagtgattcaccattttcatttccacctgatccctgagattttatgtcaagttttctggccttcgcaccttttctcaaggggctactttggacagcattttcaatggtagtttgacattagaacagttctaatgtagggtatatcgtgtttgatgacgttaataaaaaagtaaatagcctgatatatttgttttttataatgtcgtcttggaagaaaacactttcttaagtgaaaaaaatagatgaatgatagaacttggtttatcctcgaatgccaggatttgcaatgaaggttc

SEQ ID NO: 95 - DNA, 1866 bp, Glycine max
  misc_feature (1)..(1866): Glyma.05g075100.1
ataccttcaccaaagcacttgcttctttcacatggagcagagaaaaagcatatggtctcccgtcacagatccaagaagtggtttcaaccgggaatccagaactttccacagcctcaagccccctctccgtctccctccccccaacgccgccgtctccgcagccgccttcgccctcttcctccgccgcaactcgcagttcccggactcctccaccgcctttatcgactctgccaccggccaccgcctctcctacggcgagctcctccaccgcgccaaaaccctagcctcgaatctcgccacaatcctcaaactcaccaaaggcgacacagcgctcgttctctcaccaaatattctccaagttccgatcctctgcttcgcgcttctttctctcggcgtggtcgtctcccccgcgaaccctctctccacgcgctccgagctcacgcgcttcttcaacatcagcaacccctcaattgtcttcacagtaacctccgtcgttgaaaaaacacgcgagtttcaagtgaaaaccgtgctcctggactctcccgagttcgacacgctcacgaagtctcagattcacacaaaatacatccaagagtgtgattctcatcagaggggactcgtgtcaaacatgcaagtgactcagtccgacgtggcagcgattctatactcctcgggaaccacgggaacgataaagggtgtgatgctcacgcaccgtaacttaaccgcgatcgccgcgggatacgataccgttcgggagaagcggaaggagccagcggtggtgctctatacggtgccgtttttccacgtgtacgggttcacgttcagcttgggggcgatggtgctgtcggagacggtggtgatcatggagaggttcagcatgaaggcgatgctgagcgccgtggagaggttccgggtgacgcacgctacgatggtgccggcgctggtggtggctatgacgaaagactgcgtcatcgccggctacgatttgacgtcgctggaagggatcgtttgcggcggatctccgctgaggaaagaaaccgatgaggcattcaaagctaagttccccaacgtcctcgtcatgcagggatacggtttaactgagtctgcagttacccgaaccactccagaggaggcaaatcaggtgggagcaacaggtaaactgataccaaatatagaagccaaaattgtgaacccagaaacaggggaagccatgtttcccggtgaacaaggagaactctggatcagaggaccttatgttatgaaaggttattctggtgacccaaaagcaacttcagcaactttggtggatgggtggttaaggactggggacctctgttattttgatagcaaaggtttcttgtatgttgtagataggttgaaagagttgattaaatacaagggctaccaggttgctccggcagagctagaagagttactcctatctcattcagagataaatgatgctgcagttattccataccctgatgaagtagcaggccaagtgcccatggcgtttgtggtgagacaacctcaaagttcccttggcgcagcagaagttattgattttgttgccaaacaggtttcaccgtacaagaaaataaggcgtgtagcatttgttaattccatacccaagaatgctgcgggaaagatactgaggaaggacttaaaactggcgctctctaggttgtaatatgcttcattttcgttttataagtggtgtttgatttagtcttttgctccaaatgaaaaaaaaaaagaagaagcaatgcgtgtgttcagtttaagaatttatatgtaatgaaagaccttcttttgtaaaatagatcttgaactttatcaaatgatgtagtatagtaacttctcatc

SEQ ID NO: 96 - DNA, 3716 bp, Glycine max
  misc_feature (1)..(3716): Glyma.08g362400.1
gtaattgttccccgcgtgtaagttgcgctgtcttgctcgtcctttatgcttccgtttaagattaactccgaaattgtagagagagagcgtttttgtgttgtgtgtgttttcttctgtcacaacgtaatactattattattgttgtttgggacacaacaactcagagagttcttgcaaatttgcaatctctctctctctctctctctctatcccctttctgccgacgattttgtttgtcccctttggatcaggttcgttcgtttgttcgatctctcggatcagatctggattccttttcattgctgcgtcttcgatctcctttctttctttctttttatgcattattgttattactattcgcaatctcttcggtggccaatgatttttattttatccttagatttcggatttgatttagctctgctgtatctctttggtttggatcttctggctgttttctgtgattccaatgacagagtttcattcaatgtgttttgattgtttcaagtttgacatgccacaagttcgtgcccttgttgttggtttgtagcttttgctgaaatccagcaataatgaagaaggttattggtcaaactgttagggaccttaaaagagaagtaaataagaaagtgctgaaagttcctgggattgaacagaaggttcttgatgctaccagcaatgaaccatggggtcctcatggatcacttcttgcagatattgctcaggcaaccagaaaccctcatgaataccagatgatcatgtcagtaatctggaagcgaattaatgacactggcaagaattggcgacatgtctacaaggctttgacagtactagagtacttggtggctcatgggtcagagcgagtcatagatgagatcagagaacatgcttaccaaatatcaacattgtccgattttcaatatattgattccagtggaagagatcaaggaaacaatgtcaggaagaaatctcaaagtctggttgtccttgtgaatgataaagaaagaatcatagaagttaggcagaaggctgctgctaacagggacaagtttcgcaacagtacagcaggtggaatgtatagacctggttcatattcaagcagtggagcctatggtgacagatatgatgatgatcgttatggaagcagggaagaagatagaaatggctatggttatggaaaggaaagagaatggggcaatagagatgatgatcgacatagtcgtgatggagatcgttatggcagagattatgaggatcgttatggcagggatggatacagagatgacgactacaggggaagaagtcgaagtgttgattaccaatatgacacaagaagcaggagctctgatagagatcgttatgatgatgatggacaacactcatctcgtggaagcaatgctaaagctgaagaccaatctctggaagcaaggcttgagcggaaactttctgagcaaaatatgggtgctcctcctagctatgaagaagctgtcagtgaatctcgcagccctgtacacagtgaaagagatgtggaaacttcagcagcacctgctcctagagactcctctcctcatgtaaatgataatcctagtcaaacctctgctcctacgggatcttttcctgtaaacaataatccaaccgaagcaactactgctgccagtactgctgtatctggagctcaggaaactgaggcgactgatgatttttttgacccacgtggtcctgcatcagctgccccagccaccactagtaacgttgaaatggacttgctcggctccctctcagactcgtcctcttcaaatgcattatctcttgtaccagctgcatcagcaactgcagcccctgatgcaaatgctggatcaacagcttcctttgcagcaccaccatctgggtccaataattttgatcagtcttttgaagatccatttggtgactcgccattcaaggcttttacttctactgaaactgctccatctcaaccccagacatatcagagtattgagccatcccaatcaaatggccttaatgcagaaacaaactctaactttgggtttggggactcattttctgttgtaccatactctgcacctgtttcctctgacgctcaacctttctctacaaactctcagtttccgtctcaagatatgtcatcttcacagccagaaacagatattcttgcagacattcttcctcaagcaccattatctgagatgcattcacagcagaacattccagttcctacagatcaattttctcaacaacccttttctgctcctaatggccaaccaggacaagtacaatcatccttttcatctccctccagtcaatatgcacaaccacccttttcatctcatgctggtcaacctagcttgcatgcattttcatctcctactggccaacatttgcagtcgccttttgcttctcaaggtggccaacctgcacaatcaggtggtatgtatggtggattgcactcccagggtggatatccaaccatgtctcctcaatcccaaaatggatataatgggcatatgaatagtgggaactttggatcgacagcagcttttccatcacacatggctccccaagctccaacaggacagctgtcacagggcaccaacttcccccatcatggaggatctactgctcacactgctccgcatttgtcttcttattctccaactcatcaagcatcacagtttaacagccagagctttattggacaacaagggaatgcagccccctatagctcaccaattaccaatcaatcatttgcttctaatgcttcacaatccaattctttagtttctcaaccatccaaggacaagtttgagactaaatcaacagtttgggcagatacactaagcaggggattggttaatttgaatatatctggacctaaaacaaatccattagcagatattggggttgactttgaagccattaataggaaggaaaagagaatggagaagcccactaccacagctgtaacatcaactgtaactatgggtaaagctatgggatcgggttcaggtatgggtcggtctggtgctggttctctaaggcctcctcaaaacccaatgatgggttctggcatgggcaatggtcctggtgttggtatgggtatgggaggctatggaggaggcatgaatgcatcaatgggtatgggaatgggggggatggggggaatgggtatgggacaaggataccagatgcaacccccaactggattgcctcccggctccaacatgccaggtaattataataactccatgatgggttcaggtagttatggtcagcagccatatggtagttatggtcagcaaccatatggcggctaccgatgagatagaacattatgcctagatagcaaggtgaagtacattactgattgttttgctacaagttgagaaagagaaatgccaatacagtgctactagtagtagtctgtattttgaatttatagcggtgtatcattaaagctgcagtttgctgtaaagtgacccagtgtgatgtatgtgtatttcttgttataaatatgctgttaccattctttttgggtcaccctttctgtaggtgctttgagcatcaatgttgtgtaccagtgactggatataataaccttgcttgggttattgctttctttgcttgttcctcatttttttaacaccaacaggtggtttgatattaatataatttttccattgtacttttaggatcgg

SEQ ID NO: 97 - DNA, 1756 bp, Glycine max
  misc_feature (1)..(1756): Glyma.20g168100.1
aatggaaaaagtactccctatcgcgcagaagcaaaagccaccatgtatactccgtagggctcgctccttgcaatggtagatcaaattttccagtggtgcaggacaggaactgaatattaaccacatcagtggtggggaaataagcaaattaatcattatctcttaaaaatcatagttctcagcctaacggttagtctcaagggcaatcgtggttaaagatgtgaagagatagaaggaattggaacctgaatcgccaagaaaaattccttattacttaagaaacaacatttgcttattctcaggaggaggagaataaggatgtctcacaggaagttcgagcacccaaggcacgggtcactgggatttctccccaggaagcgtgctgctcgtcacaggggaaaagtgaaggcattccccaaggatgacccatccaaggcacccaagctcactgcattcttgggttacaaggctggtatgactcacattgttagagaggtcgagaagccaggatcaaagcttcacaagaaggaaacatgtgagcctgttacaattattgagacccctccaatggttattgttggtgttgtgggttatgtgaaaactccccgtggtctccgaacattgaacactgtatgggctcagcacttgagtgaggaactgaaacgtaggttttataagaactggtgcaagtccaagaagaaggccttcaccaagtactcaaagcagtatgaaactgaggagggaaagaaaaacattgaggcacagctggagaaactgaagaagtatgctactgtggttcgtgttttggctcacacccagatcaggaaaatgaaagggttgaagcagaagaaagcccatatcatggaaattcaggttaatggtggtactattgcacagaaggtggactttgcatacagtttctttgagaaacaggttcctattgatgccgtgttccagaaggatgagatgattgacatcattggtgtgaccaagggtaagggttatgagggtgttgtcactcgttggggtgttacccgccttccccgtaagactcacagaggcttgaggaaggttgcttgtattggtgcctggcatcctgcaagagtttcattcactgttgccagggctggtcagaatggataccaccaccgaacagagttgaacaagaaggtttacaagcttggcaaagctggagatgaatctcactctgctcttactgagtttgataggaccgagaaagacattaccccaataggtggtttccctcactatggtgttgttaaggatgattatatcatggtcaagggatgctgcgttggtcccaagaaaagggttattacattgcgccaatccctccttaagcagacttctcgtgttgctctggaggagatcaagctcaagtttatcgacacctcttcaaagtttgggcatggtcgcttccagaccacacaggagaagcagaagttctttggacgcctcaaagcataattttgttaattggatggaaatgctggatttctattcggttaccatatcttataaacatattgtagtgttttctgttttgacattatggatccccgagtgagtagtgagttttttccccccttaagttggccaaacttttgttgagactgatcttttaaaaaattccaaattgtttgattttatctatattttcagtgttgaaggaatttgcgaaattatttaatcttttgaaacaaaattcatgatcgacatgatagtgggtttcttg

SEQ ID NO: 98 - DNA, 1114 bp, Glycine max
  misc_feature (1)..(1114): Glyma.07g165700.1
acaagtccaactccaacacaaccaccatctcccccatgtgaacgttacattacaccttagtttggttttgtagcattattatccctaacccatcaaaaacagcaacaacaactattgttgaattaattgcaccaaatattgtttgttgtaattaatactccaatggggaatgccttggggggaaagaaaaccacaaaggtgatgaagattgatggggaaaccttcaagcttaaaaccccaataaaagtttgtgatgtgctaaaaaaccaccctggtcttgttttattggagtccgaggctgtgaagcattatggtataagagcgaagcctttggaggcccacaaggagttgatgccgaagaggttttacttccttgtggagcttccgaaggaggcgacggtggcgccgaggagggttcgctcggggatcaacatgagcgccaaggacaggctcgagagtctagttctggctcggcggtctgcttcggatcttacgatcatgaagccgctgtcgagtgagccggcagagaatgggggactgaggcttaagatgaggctgccgaaggccgaggtggagaggctgatgagagggtgcgagacagaggctgaggctgcggagaagattatgggactttgcatggtgaatggtgggaatggaaatggggaggtgaaacattggaagggtgttagagccagagctggggaaagtactaaggcacgtgagaaaagggtgagttttatgccaatcattgaaggagggagtccaatagctgtggcttcgtaattacaacatattttacattagctttgaaacacagtgcacccttcagtgttgctgcgagccagggagagttatctcacaaaaggaatgatcttcctggtgcatagtttaatatataagagtgatgttatttacattttcatgctatatatatgttttgaagtcacaaacggtttctataactatatgggtgtttgcaattatattagtttcactagacagtaaaatgtagttcaggtacctttgtagctatgaattactgaacgtacgtatgtttcaataacattatcccacaaattattatatgtagagaagagacatcattaatggctgt

SEQ ID NO: 99 - DNA, 2571 bp, Glycine max
  misc_feature (1)..(2571): Glyma.05g049500.1
gaattccaaagttaaggaaagtgataggtaattttatcagtgatttaggatttgaattataattaatttttagatatagaataaattatgatacatgtaattataacatttgaggaagtttattaagaggttcaatcgaggtgtgttcagttgaagaagccataaataaatcttcttagcttccatcaaatctcacactctcattcttagagccatggccatggattccatggccgcttccatcggagtctcggtccccgtgctacgcttcctcctctgctttgccgccaccgtgcccctcagcttcctctgccgcctcctcccccgtggcctccccaagcacctctactccgccgccgtcggcgtcgccctctcctacctctccttcggcgtctcctccaacctccacttcctcgtccccatgttcctcggctacgcctccatgctcctctttcgtccccgatgcggcatcctcaccttcttcctcggattcggctacctcattggctgccacgtgtattacatgagcggtgacgcatggaaggaaggtggcatcgatgccactggggccttaatggttttgacgctcaaggttatctcctgtgcggttaattacaacgatggattgctgaaagaggagggtttgcgtgaggctcagaagaagtaccgtttgatcaaattgccttccttgattgagtacattggttactgcctctgctgcgggagtcactttgctggtcctgtttatgaaatgaaggattatcttgattggactgaaggaaaagggatttggagcactgaagcaaaagggccattgccatcaccttatggggcaaccctccgggctcttctccaagctggtttttgcatggccatgtatttgaacctcgtgcctcattttcctctgtccaagtttactgatcctacctaccatgaatggtgtttctggaaaaaattaagttaccagtatatgtctggctttactgcacgttggaagtattattttatctggtcaatttcagaagcttctattataatctctggcctgggtttcagtggctggactgattcgtccccaccgaagccttgctgggaccgggccaaaaatgtagatataataggtgttgagtttgcaaagagtgcagttactattccagctgtgtggaatattcaagtcagcacctggcttcgtcattatgtttacgaaaggcttattcagactgggaagaaacctggtttcattcagctacttgccacccagaccgttagtgctgtttggcatggcttgtaccctggatacataatattctttgttcagtcagcattaatgattgctggttccagagtcatttacagatggcagcaagccgtacctccgacgatgtctctggttaagaatgtgttggtgtttacaaattttgcttatacacttttggttctaaattactcctgcgttggtttcatggtgttaagtctgcatgaaacccttgcctcatatggaagcgtgtattacattggaactattattcctgttgttctgattcttcttgccaaagtaatcaaacctggaaagcctgccagatctaaagctcggaaggaacagtgaggtagaaaatgctgtttattcttgttggaaattttgaaatcagattaggagaaagcgagagaacgggtttccagtttccacaggttttctgcccctggttttcaaccttgtaacagctcctttggtcctgaatatggttgggcgctttcatactcttgcctttagcattgaactgtatttctgtgataagaaacatcttgttggcaggtttgataaaagcagttattgaagacatgttagaaacatttgtatttcggtgatttctctctactttcagctctgattcccaacaattactgcaagaggctctagttttcaaatgttaactgtagacaaatatgcagatactctgatgtatggcagtataactgtactatctagtattcatttctccaagtcacttgtcattttgtacaaaaatgatacccgccttgttggacataaagtatgggcactgttactaagaaaattttggatcggaactgcctatcataggtcttcagaattttatattttttcctgaaatgtctgggacagtgcttacccaactgacctaaggatatctaaactctgtaggtttagaatgccctgaaaatctcttttgccttaagactgagatatacgataaggtgagctagtattcttttgcatgtatggcctctaattgcctatttcaagtgtttctagaccatgccaataagaaaaaaaaggaacagggagggagagcgagaagtctccataacgttaagtttgttgaaggtgaaatgagatattcaatccaatcgaagtaccattctcgtcttaatctattcctgacgtatcagctggtttctccggaatttcagttcttaaaatgtcactaatgcaaacaaatgaacatggtgttggacttattttataatgatgatgggattccaagatttctttttgtgttggtgaataagatttgcgcatccttataacaa

SEQ ID NO: 100 - DNA, 1026 bp, Glycine max
  misc_feature (1)..(1026): Glyma.14g142100.1
atgaaaaacacggagaggattgcaaatttggccgtagcaggtttaactttagccccgcttattgtgaaagtagattcaaatgtaaatgttatcttgactgcttgcctcaccgtgtatgtgggatgttatcgttctgtcaaaccaacaccacctactgagacaatgtccaatgaacatgcaatgcgtttcccctttgttgggagtgcaatgttattatcacttttcttgctcttcaagtttctatctaaggatttggtcaatgctgtgttgactggttacttctttttactagggattgtcgctctatcggcaacattattatcatctgtcaaacgttttttgccaaagcattggaatgaggaccccatagtctggcgttttccatattttcgttctttggagattgagtttacaaagtcgcagatcgttgctgcaatccctggaacctttttttgtgcgtggtatgccttgcggaagcattggctagcaaataatatattgggtcttgctttctgtatacagggaattgaaatgctctctcttgggtctttcaagactggtgctattctcttggctggactctttgtttatgacattttctgggttttcttcactccagtgatggtcagcgttgcaaaatcatttgatgctccaataaagcttttgttccccaccgcagattctgcaaggccattttcaatgcttggacttggtgacattgttatccctggtatctttgtagctttggccttgcggtttgatgtttctagaggaaaacagccccagtatttcaagagtgcatttttaggatacactgttggcttggtccttacaatcattgtgatgaactggttccaagctgctcagcctgcccttctatacattgtaccttctgttattgggtttttagctgctcattgcatatggaatggtgacgtcaaacagttattggagtttgacgagtccaagactgccaaatcatctcaagaggagggtgatgccaaatctagcaaaaaggttgaataa

SEQ ID NO: 101 - DNA, 1836 bp, Glycine max
  misc_feature (1)..(1836): Glyma.03g114700.1
taattaagaacatatcacgcgggacacacgaatagaaaatgaaacatagatcgatggagaataataattgcacatatataaattaatctcctagagctatggtaatgaaaaattgcagatacattagcaaaagcaaagcagttgaggaagggtatgggaagagagagcttcatacatttctgaagaaagtaaatatttgaactaagacagagccttccatcacaggaaaaaggaagtattgtttgaatggcttcttctgcagctagttacactgcagtacctgaaacagaaccccggattgaacacataattaacatcaatcctaaagacattgaacctgcatggcatgatgtgtgctgcatttacaaggttcctcctaatctcaaaaatttgaaggttgaagcctatgcaccacttttgatctcaataggcccttttcatcacaacaaaccagaactagagccaatgcacaaacagaagcaaaggtattttctttccttctgggaacgtgtcacaaacaaaaaggctttggccaaatacaaagccttcctcaatgaaaacatcgaagcaacgatacgccaaaggtattcagagccgattactagcttcagcaatgatcagtttgtggaaatgatcctcttagactcggtcttcattttggagctgtttttgagaaaatcagaaaaatctaagcaagaaaaggattacatgttcaccacaccatggatttacaagggtatacaaagagacctcttgctacttgaaaatcaacttccaatttttgtcttggatgagttacatagaagggtttgtaagcaaaatggtgttagctttcttgagcttgcatttaactactttgaagattattatccttatccacacaaatcaacaacaacaagtgattatgatcaaactaaagagatggtcaagaagaacttcaaatcttgtaaccacttcactgatttgataaggcttttctacctcccagaaagggttcatgtcaaggagtggatgccatcaaaacatttcaccccttgtggtaaaaatgaatgtgtacttaagactgcagcaaagttgaatgaggcaggggttagctttgagaaattgcaccaccacaagtgcttgttagacataaagttcaagatggttcctgttttgagctggtttctatgcttaggttgcataccatgctctatgtgtgtcaaagctcgtttgcaaattcctcagttgaaagtgctccaaacaacagaatgtgtcctaaggaacctcattgccttggagcagtgtcactattcagaccaacctttcatatgcaactatgtttctctaattgactctttgattcacactcaagaggatgtggagttgttggttgacaaagaaatcattgtgcatgaacttggctgccacaatgaattggcaactatgataaatggtctttgcaagcatgttgtggtgaattgcaattattatggcaaaacatcaaggaaactcaatgatcactacaattgttgttggaaacattatatgggtatgttgaggtcagtgtacttccgtgacccttggagactcagctcaactgttgtaggagttgttatcttcttgtttgctattgtcaactttcttcgagttaccaatttatatcatccaaaagactgaattgtttgagtagttttattcgactccaatagaattatctcatatgtaaaagatatatgtatttgatataaaaataactgaactgtttggtggtgtaatttaattaattagttacttgatttccttgtatcaatgttcagccagtaataaatctagatgcatgtctggttaaagttt

SEQ ID NO: 102 - DNA, 1254 bp, Glycine max
  misc_feature (1)..(1254): Glyma.07g059900.1
cactcctttccgtcacttttggggaagaggtcgagtttcacagcagcaatggtgtacgtcaaggctcagaaatcaaaagcctacttcaagagatatcaagtcaagttcaagagaagaagagagggaaaaaccgattaccgtgccaggattcggttgattaatcaggacaagaacaaatataacactccgaaataccgatttgttgttcgctttagcaacaaggacattgttgcacaaataatatctgctagcattgctggcgatattgttcttgctgcagcatatgcacatgagctgccacaatatggtcttgaagtagggcttacaaattatgctgcagcttattgcactggtctcctgttggcccgaagagtcctcaatacacttgaaatggatgaggagtatgaaggaaatgttgaggctactggagaggattattccgtggaacctgctgagagcaggaggccattccgtgctctccttgatgttggtcttattaggactacaaccggtaaccgtgtgtttggtgcccttaagggagctctggatggggggttggatattcctcacagtgataagaggtttgctgggtttgataaggaaaagaaggagcttgatgctgaggttcatcgcaaatatgtttttggtggacatgttgctgcctatatgaagatcttggctgaagatgaaccagagaaataccagtcacacttcagtgaatacatcaagcgtgggatagaagctgatggtattgaggcactgtataagaaggttcatgccgccattcgtgctgatcctactcttaagaaatctgataagcagcccccgaaggagcacaagaggtacaacttgaagaagctgacttatgaggagaggaaggctaagttgattgcacgtgtggcgtctctcaactctgctgctgataacgatgaagatgatgagtgaaagttcattcaagattccgtatcatcgttgcacaactagaaactatcttattttgcgtctagggaatcattttcttgaaaatttatttacatgtactgtttattttctaggtccgaaattttggatactatttttgaagttggagtagccgttttttttgtcagtttcgtgttagcctgaattgatgttttaccatactttgatgacatacgctttatttctagcaggaagtgttttggttttacgaacggttgccctttttttttatcggcaattaaaaaatatacagctataatttttcaggttaaa

SEQ ID NO: 103 - DNA, 3453 bp, Glycine max
  misc_feature (1)..(3453): Glyma.05g105000.1
gagcatcaaagtggttcctgtcagatgagcgtgcatacactgcatgcatagcctgacacagtgaccactgaaaacacggagtaagagaaagaaagtgaagactgtgaggggcctcatggtcatggtcgtggtcatcattttaacagaacttacttttactttattattactcctattactacttccaacctgaacggaactactaataaagctcatcattcttattattattcactttaaaagccacactttacaaagtcacacacataaatcaattctttctttcttgctaaactttttctccattttctataaatcatggacaacttggactgttgcatatttcgttaatgcttttgtttggtagcattagaggctacgagatggaatggtggtggtggggttgagggtgttgctcatccaaaagtttattttgatcaaagagagagagagagagagagaagggaacattgtgatatgaatgatggttggctttttgtgtttgtgtagcagcggtggctgccaaaaatgatgaccaacaactttatctttttgaagggtggtcttttgggtttggttgggtagtttgtgtgatatgtggggttcttctcttctttcatgatatagtaatagtttcactcactcacgcacacactgaactttgtgtttcttgtcgtggccactcccatgttagattctttttacttggcagagccagacacatgaaaattttcctgatttcagatctctttgattaatattgcctctgactctttgcctctctacaactttcctttcctttttcttgttatcttcttctgcttgtttttactcgccttatcgtgcaatccacactttgatttggttggtttctccaatatttattgtgagaagaagaagaagaagaagaagaacatttaagggtcttgtgctgagctttaaaggagggacaaaggtgaaacgtggctagcataggaaaaagaggtagaacaacatagggaaaaaggagaaacgtagtcatttcctttggccaagatgaagtttatgaaacttggatctaagccagattcttttcagaatgatggggataatatcaggtatgtggcaactgagttggcaactgacatagttgttaatgttggaaatgtaaaattttatctccataagtttcctcttttgtcaagaagcacgtgcttccaaaaactgattacaaacgctaatgaggagaacaatgatgaagttcacatccatgacattcctggtggacctgctgcttttgaaatatgtgctaagttctgctatggtatgacagtcactcttaatgcatacaatgtcgttgcagctcgctgtgcagcagaatatcttgagatgtatgaaactgttgagaaaggaaatcttatctacaagattgaagtcttcctcaactccagcattttcaggagttggaaagactcgatcatcgttcttcaaactaccaagtctcttcttccatggtctgaggaacttaagttagtgagccatggtattgactccattgctaccaaggcttcaattgatacatcaaaggtggagtggtcatacacctataacaggaaaaagctaccatctgaaaatagtaatgatcctcacttcaatagtgtgaggaaacaacaattggttccaaaggactggtgggtggaggacctttgtgagctccaacttgatctctatgaacgggttataacaacaattttaaccaaaggcaatgtttctggttctgtaattggagaagctctaaatgcttatgcctcaagaaggatgcctggcttcaacaagggtgtgatccaaggaggagacaatgtaaagaatagattattgttggagaccataatccgaatattacctttggatgtgggcagtgcctctttcagtttcttggggaagttattaagggtagctattcagttggaatgtgaagagttggagagatctaaactgattaggagaataggtatgtgccttgaggaggctaaggtgtctgatttattaattcgcgccccagttggtgatgcagtttttgatgttgatattgtgcaaaggctagtagaagagtttctagcatgtgatcaacatgttcagacggatactctgttggacgatgaatttcaggagacaagaagccctgggatggtatcggaatcttcgaaggcaaaggttgcaaaactggtggatggataccttgctgagattgcacgtgatccaaatttacctctttcaaaatttgttaatcttgctgaattagtatcaagctttccaagagcatttcatgatggcctttatcgtgcgattgacatgtatttaaaggagcaccctggaatcagcaaaagcgaaaagaaaagaatatgcaggttgatgaactgcaggaagttgtcagcagaggcttgcatgcatgctgtgcagaacgagcggcttcccatgcgcgttgttgtgcaggtcctcttctttgaacagctgagagctacaacatcatcaggaggcaacggaacaccggatcattccggctctatcagggcctctcttcccggtggatctcatgggagttcaaggtcggaagaggaatgggaagccgtgggaacgatggaagacataaaatctctgaaaggggagcttattgctctgaaattatcaggaggaacaaggggagccagcagcagaagcaacaacaatgacagtagtaaaggcaattctgagagtgttgctgctagtaaaatgaaaggtctcgtgtcgaagaagataatctccaagatttggtcaagcaaagaaagaagtggtgagctaagtagctctgatacatcagagagccctgcttctacggttgtagaggaaacaaaatctactccatctagaagtaggaggcattcattgtcttagagaccatgttctgcagaccttattccttagagctccattcagtttactgtataatcatctctcactcaagtagcatcagagttagaggacactgacatcatattccagctgatacttcaatcagaaatcaatataactgtgagcaaatgttggcatgtggctaaaatatgaagcaccaaaagtacatgttaattgaggtttatatcatgcccctagcctagggatgcaacttttattcagccattactgatattattaggttagaatgtgagctcttgtagtgagttatccagttttgattattggagactggtttgtgactgctacaatttgtaagcttagttttaaagggaaaaggaggataaggaggtgcagtgtttggaaggcttgtgttgggagtattacttagctttgatccgtcattaatgttcatttgagcactagtatgagctgtaaaccattggacttaaaatttaccattcttgaaacacggaggagatattaggtatggtaaatttgaattccaaatgctataccttgtcc

SEQ ID NO: 104 - DNA, 7340 bp, Glycine max
  misc_feature (1)..(7340): Glyma.08g139300.1
gacgcttagctgtcagctaataagctttggtttgaggctgaacttggcactgtcggtgtcggtgctccggtgagtgacggcgagatcctcaaaaacaaaaacacttcctactacttcctatccttccatctcattgaaaagttgaaaacgtaagacacaatcaaaactaaaaaaaaaaaaacaataaataaaaacaaaatagaataaaaaaagaaaaaggtacaaccaactacatttgttcctcttccaattgtgtcgtcttatcttctacgaaacccatacatagatgcatgtgattgtgatgtgcaccttcttcttcttcttcttcttcttctattccactcacaccattgctgaattcttcgacattcattcatcttcttaaccatactccacttccactcataccttacttacttactatattggatctgaatgaatcaatgatgctttgtctcttccagatctgaacttgttcaactcaaactgaaccccccatggctacctcactcgcttggagacttgctgccaacaatggcaccacccttgccgcaaatgatctggaaagaaatggtgacgggaggactcaagattcagagcccccaactccacattctgttctgaagatgggattgagagagcgtaacagcagcatggaggatccagatgggacattagctagtgttgcccaatgcattgagcagctgcgtcagagctcatcttctgtgcaggagaaagagtattccttaaggcagttgttggagcttatagatctgcgtgaaaatgcttttagtgctgttggatctcactctcaggcagttccagtacttgtttcccttctccggtccggttcattgaatgtgaagatacaggcagcaactgtcttgggctccctttgtaaagaaaatgagctaagggtgaaggtcttgcttggaggatgcattcctccattgcttggtctactaaagtccagttctactgaaggccaaattgctgctgcaaagactatttatgctgtctctcaaggtggtgtaaaagatcatgttggttcaaaaattttttcaactgaaggagttgtaccagtgctctgggagcagctgaaaactggcctgaaggcaggaaatgtagttgaaggtttattgactggtgcattgaaaaatctctccagcaatactgagggattctggaatgcaacaatacgagctggagcagtggacatattagtgaagttactggcaacgggacagcctagcagtttagctaatgtgtgcaatttacttgcttctgtaatggtggaggatgcatctgtttgttcaaaggtgttgacagcggaggtgacaaaacaacttctgaaactattaggcccaggtaatgatgactctgttagagctgaagcagctggtgctctgaattctctttctgcccagtgcaaagaggcacggcgagagatagccaatgctaatggtattcctgctttgattaatgctaccatagctccttccaaagaatacatgcagggtgagtgtgctcaagcattacaggagaatgctatgtgtgctctagcaaacatctctgggggtttgtcttttgtcatatctagccttggccaaagtcttgaatcatgcacctcacctacccaaattgctgacacattaggagctttggcatcagctctcatgatatatgataacaaggcagaatcttccagagcatcagatcctttggttgtcgagcagacattactcaagcaatttaaacctcgcttgcccttccttgtacaggaacgaaccattgaagcacttgctagtttgtatggaaattccatactttcaaataaactcgcaaattctgatgcaaaacacctgcttgttggtttgataacaatggcagctaatgaagttcaagacgagcttataaaagctctgttgacactgtgcaaaagtgaaggcagtctatggcgtgcacttcagggccgtgaaggggttcagctattgatatcccttttggggctttcatcagaacagcagcaagagtgtgcagttgccctgctttgccttctatcatatgaaaatgatgaaagtaaatgggcaattactgctgctggtggcatacctccacttgttcaaattttggagacaggatctgcaaaagcaaaggaagattcagcaacaatccttaagaacctgtgcaatcatagcgaagatatacgtgcttgcgttgaaagtgctgatgctgttcctgcattgttgtggctattgaagaatggaagtccaaatgggaaggatattgcagcaaagactttaaatcatttaatacataaatctgacactacaaccattagtcagcttacagctttattgactagtgatcttcctgattctaaggtttatgtcttggatgctttgagaagtatgctttctgttgctccccttagtgaaattttacgtgaaggtagtgcttccagtgatgcatttgataccatgataatattattgagctctaccaaagaagaaactcaggaaaagtctgcatcagctctggcaggaatttttgaaacaaggaaagatgtgcgtgaaagtagcattgctgttaaaactcttttgtcagccatgaaattgcttaatgctgaatctgaaagtatcctgattgagtcctcacactgcctggctgcaatatttctttccatcaaagagaacagggatgtagctgctgttgctagagacacattatccaccctagttgcactagcaaactcttcagttttggaagttgcagagatggccacgtgtgctctggcaaacctcattttggatagtgaaattgcagagaaagctattgcagaagaagttatcttacctgctactagaatattatgtgaaggcacaatttctggaaaaacccatgctgcagcagcaattgctcgtctcctgcattctcgggatgttgattatgctgtaactgattgtgtgaatcgtgctggaactgttcttgcattagtttctttcttagattctgctgttaatggatctgttgccacatcagaggctctagaagcacttgccatcctgtccaggtcagaagagaccagtgcaaatattaaatctgcttgtgcagttttggctgaattccctaaaagcataagcccaatagtcttgtgtattgttgattcagagccaacattgcaagataaaacaattgagattttatctcgattgtgtaaggatcagcctgttgttttaggcgatactatcgtgtcagcacctggatgtatatcttcaatagctaagaggataattagttccacagatgtcaaggccaaaattgggggagcagcacttcttatttgtactgcgaaagccaatcatcagagactggtggaggatctccattcgtcaaacttgtgtgccgatcttattcggtctcttgttgatatgcttacttctgcacagccttctttgggttacctggatgatgacaacaaggaattcattagcatatgcaggtacacaagagaagaggccaatggttgtgaatccaacactagcactagcattatatgtggtgctgacttggcgatatggttactgtctattctggcttgtcatgatgaaaaaaataaaattgcaataatggaggctggagcaatcgatgttctcattgacaggatctcaaattgtttctcacaatattctcagattgaatacaaagaagatagcagcatgtggattcatgctttgttgttggcaatattatttcaaaatagagatatcatacgggcacatcccaccattaaatctgtaccagcacttaccagtttattgaagtcagaggaatcagcaaacaaatattttgctgcacaatcaatagctagccttgtctgtaatggtagcaggggaacacttttgtctgtggcaaattctggggcagcaggtggacttatctctttgcttggctgtgctgatactgatatacaggatcttctggaattgtcagaggaattttctttggtgcgttatcctgatcaagtggctcttgagaggttgtttagagttgatgatataagagtgggagccacttctcggaaggcaatacctgctctagttgatctgctcaaaccaattccagatcgtccaggagcaccatttttggcacttgggcttttgactcagcttggtaaagattgtccttcaaatatgagtgtaatggtggagtctggggccttagaggcacttacgaagtatctttcactgagtccacaagatgcaactgaagaagctgctacagatctgctaggaatcctgtttagcagtgctgaaatacgaaaacatgaatcagcatatggtgctgttgctcaacttgtagctgttctacgtttaggaggaagaggagcaaggtatagtgctgcaaaagccttggaaagtttgttttctgctgaccacattagaaatgcagagattgctcggcaagctgttcaaccattggtggagattctcagtaccggttcagaaaaggagcagcatgctgctattgctgcattggttgggttactgagtgaaaacccatcaagagcacttgctgttgctgatgttgagatgaatgcagtggaagttctttgtaggatcatttcatcaaattgttcaatagacttgaaaggggatgctgctgaattatgctgtgctctttttggaaatacgaggattcggtccacagcagctgctgcatgctgtgtcgaaccacttgtctctctccttgtgactcagttcagtcccgctcagctttcagttgtccgggcattggataggcttgttgatgatgagcaactggctgaattagttgctgcacatggtgcagttgttcctcttgttggtctactgtctggtaggaactatatacttcatgaggctatttccagagctctggtcaagttaggaaaagacaggcctgcttgtaaagtggaaatggtgaaagttggagttattgaaagcgtacttgacatcttacatgaaggacctgattatctatgtgcagcttttgctgaactgttgcgtatattgaccaataatgctagcatagctaaaggaccatctgctgctaaagtggttgaacccttgtttttgttgttgacaagacaggaatttgggcctgatggacagcacagtgcattgcaggttttggttaatatcttagaacatccacagtgtcgtgctgaccattcattgacttctcgccaagttattgaaccacttatccatttgcttgactctccaatttcagcagtgcaacagttggctgctgagcttctttcacatctacttgtagaagaacgccttcagaaggatccagtgacacagcaagccattggccctctcgttcgagttcttggttctggtatacacatattgcagcaaagagctgtaaaagccctagttagtattgcactaacatggcctaatgaaattgctaaagagggtggtgttattgaaatttccaaagtgatattgcaagctgacccttcccttcctcatgctttatgggaatctgctgcctcggttttgtcaagtattctgcagtttagctctgaattctacttggaagttcctattgctgtattggtaaggttgcttcgatcaggctcagatagcacagttgttggtgctttaaatgctcttttggtgttggaaaatgatgacggaactagtgcagaagctatggctgaaagtggtgctatagaggctctcttggagctcctacgatctcatcagtgtgaggaaattgctgcaagacttttagaagtattgctgaacaatgtgaagattcgagaaacgaaagtaacaaagtcagctatcgtaccattatcacagtatcttttggacccacaaactcaagcacagcaggcaaggttgttggcaactttggctcttggggatctgtttcagaatgaggctcttgctcgaacaagtgatgcagtttcagcttgtcgtgctttagtgaatgtgcttgaagagcaaccaacagaagaaatgaaagttgtagccatatgtgctttgcagaatcttgtgatgtacagtcgatcaaataggagagcagttgcagaggccggtggtgttcaggttgtattggatctgataggttcaagtgatccagaaacatcaattcaggcggcaatgtttgttaaacttctcttctcaaataatactattcaagagtacgcttctagtgaaacagtcagagcaattactgccgctattgagaaagatttatgggcttctggaactgtgaatgacgagtatctgaaagccttaaattctctatttaccaacttcccaagacttagagcaactgaaccagcaacccttagcattccccatctggttacagccttaaagacaggttcagaggcttgtcaggaagctgcattggatgcacttttcctgctcagacaagcttggtcagcatgcccagctgaagtttctagagctcagtcaattgcagctgcagatgcaattccattgctgcagtacttaatccagtctgggccacctcggtttcaggagaaagcagaatttttattgcagtgtttgccagggacattggtggtgatcatcaagcgtggtaacaatatgaagcagtctgttggaaacccaagtgtttactgcaagcttacacttggcaacactccaccaaggcaaacccaggtggtttcaactggccctaatccagagtggggtgagagcttttcatggacctttgaaagtcctccaaaaggccagaagcttcatatttcttgcaaaaataagagcaaagtgggaaagagtaaatttgggaaagttacaatccagattgatcgagtggtaatgcttggatcagtagctggagagtatgctttgttgcctcaaagtaaaagtggccccccacggaatctagaaatagaatttcagtggtctaacaagtgataccatccagctttcaaattggaacgttaaagatcaagctggaaagaaatttttggattttttttttattacaccacatgtatatagctgttgtttatttttggtcaaaacagattcttttgtcataatattcttttgtaacttgatctttcattcctaggataaacactaggagcacgaagatcaggccagcttcgagtttcttgtatgattctttgcttgttgtcaatttaaagtgatatagcgagtctgtttttgtcttttttgctttggggcttgtatgagtacgacgacttagtataattatttgacgctaaattgaatgtaaaataacagtgacaaatattgtcgtacttgtagtgtggatccataatggagcttgtgctt

SEQ ID NO: 105 - DNA, 1309 bp, Glycine max
  misc_feature (1)..(1309): Glyma.01g038700.1
ttttagaattatctaatcataatcattaaactcatataaaaataaacaaattctttaaataaatcacaatacttcatctcgaaagattaatctgtaattttctgaacttttttttaatgaaacatgttttgagaatgatttggaccgacaaagtatttaaaagcaaatgataaataaataaataaaacagaattgcttgcatcccaggtttcaaatccagggaaagagagaagagcaaagacacagagtaagcaatgaaatttccaaattcccaattgttttttccactcttcttcttcttcttcttcgcctttactccctttcgcgctttagggcagcaaacggattggaacagcgaagagactcaacatggaaatggggttcgccgcagagttcttctgagtttcaaagaaaagccctcaggaagtaacgttacctttgaatgtgctccttcgggtccctgtgtcccctgcctctactctgagaagggtgatgagaaatatcggtgcagtgagactggctaccgaattccattcaaatgtgtagagattaaagactcaacgaaggatgcaaagaaaacaaagtctcaaaaaggtcggttgtctttggaaatttctgatggtattgcagaatctcatatagtgtcacatgttgctggagaaatcaatccttcacaatcacatagaagattagtggatgattcattgtcttcagataatagttcacaggcttatatcacttatagaagctgtataaccccagttaatgaagaaaagttgtcattgcttaactttgaggggttggtgatttttttgttactaatcagtggatcaatcatatacttgagaaaaaaaaaggctgcatccatgtctggttatgtagcaggaaggggtcaaaacaactctcgattctgaaattgacgcctaatgaatgatgacatttgtactccatattgattgtaatatagccctaatgttggtatttagtggtctcctttgtatttttgtagtgatttaaatgtagtatagttttactggcctacggcatcttttgctcttatcaagtcatggatggaccacgttagtcattattatttattgtattttgaggccatatagtttgggtcaattttggctaatttattggaagataggatttttaggattttatttttttcatcaaatcagaacttgtcttgtataagtattttatatttatttttatgtcttctcaaatgttattgtcaagatttttttgttgttgagaggggtgtaaagattgctatactatcaacttattagaaattctc

SEQ ID NO: 106 - DNA, 2295 bp, Glycine max
  misc_feature (1)..(2295): Glyma.13g278800.1
ccaaactcacccttaacattatttatagctatggttgaacagtgagcaccaaactgaattgaaattgcaccaaatccacaaaaggcagcacacttacacactatcatgttcattgatgctataaacacacttgtgtgtgaagttatgattcctagaaaagaaatattactatccttttgaaaatcatttgaaatttttaactccatcttcctcacctctggatctgatcttcgcacggtgccatggatcgaatcctgaaagcggcgagagcctctggttctctcaacctctccaatcgctccctcacagaaattcccgacgaggtttaccggaatctggaggggctcggcggcgacgacaagtggtgggaggctgcggagcttcagaagcttattctggctcacaatagcattgcatcgttgaaggaagatctgaggaatttgccttttctttctgtgttgaatcttagccacaactctctttctcagcttccagctgctattggagagctgcctcagttgaagatgttggatgtttcgttcaattcgatagttaagataccagaagagattggatcggctgtgtcacttgtgaagcttgattgttcaaataatcggctcacggaacttcctagctcgcttggcagatgcttagaattgtcggacttaaagggatcaaacaatcttattacaaacttgccagaagatttagcaaattgttccaaattgtctaagctagatatggagggaaacaggctaacagtgatgtctgaaaatctcatttcatcatggaccatgcttactgaattcaattcatcaaaaaatttgctgaatgggattccaaccagcattggaggtctttcacgtctaatccgtcttgaccttcatcaaaacagaatatcagcaatcccttcatcaatcatcggttgtcattcacttacagagctttatttggggaataacaatatttctacattaccggtggaaataggggccctttctcgccttgggactttagatcttcactctaaccagctgaaggactatccagtagaggcatgcaaattgagtcttttagtcttggatctttctaataattcattgagtgggttaccccctgaaatgggcaagatgactacattgaggaaacttttgcttagtggaaatcctatgagaactcttcgaagctcgttagtatctggacctacaccagcattactgaaatttctccgaagcagactttctgaagatgaagattctgaagcagtaaccacaacaaaagaggtgatcacaatggctacccgattgtctatctcttcaaaggaactttcgatggaagagctggggttgagtgctgtcccatcagaagtatgggaatcaggggaggtcataaaacttaatctatccagaaactccatccaggagttgcctgttgagctttcttcttgtgtttccctccagacattgattttatctaagaatcaaattaaagattggccaggttcaattcttaaatcactttcgagcctttcatgtttgaagctggataacaatcccctcagacagataccttcagatggctttgaaatggtgcctaagcttcagatcctggatctaagtggtaatgcagcttcattactagatggtcctgcattttctagtttgccatacctgcaagagctttacctaaggagaatgaggctcagtgaagtcccatcagatatagtggggctgcatcagctacggatccttgacttgagtcagaattcccttcaatcaattccagtggggctaaaagctctcacttctctccaggaacttgacctatctaataacaacattgcagtccttccgcccgagctgggtttgctggaaccaagcctacaggcactgagacttgatgggaatcctctcagaagcattcgaagaactgtgttggataaaggaactaaagctgttctgcaatatttgaaggacaaattgccagagcaatagtgtttttagttttttccctcctttgaaagtgttgtgcttgacatgaacagcaatatttaaagtgtccaatttttttttcaggtgtcacattctgtgtttgctctttattttgttcaattattttcccgtggtacctctgcttttgtgtgctatttcatgtaacaattttgacggtttgaatatttaacattacaaactaatttgcatggcttgaattgatttcccctcgttttgtatgtagaatacatatctattattgatttatatactactactagctttgctccttgatataagattt

SEQ ID NO: 107 - DNA, 3135 bp, Glycine max
  misc_feature (1)..(3135): Glyma.06g056300.1
tttatacgcgcgtttacaatagtaagcagtaattatccgtcggtgggcgccgaatgaggcacgtttcgcattctgattggaagcattcgaaatattcaacgaacagtgcgaaattagcaggtacactaacatgaaaaactcgtggctaacaacaacttctcttctctccgattatggctactcatcttttcagacttcctctcttctcgcaacccaagctctccttcaatcacacgcctaatcatgcactccacttcatttctcctctgccggcaaaacgacatcgcacccgcaaccgccaccgtcgtcgaattctccggccaccgttctctgtttcgaactccttcggcaccgagattggctcgccggaattttctctccttcaaagcaggagagaggccaaagactcgccggttctgctcgacgtcaccggaatgatgtgcggcgcgtgcgtctcccgagtcaaaaacatcctctccgctgacgaccgagttgactcggtcgtggtcaacatgttgaccgagaccgccgccgtcaagctgcggcggatcgaggaggaaccggcgagcgtcgcggagagcctcgctctgagactgagcgattgcggatttccgacgaagaggagggcgtcgagctcgggagtgacggaaaacgtgaggaagtggaaggagttggtgaagaagaaggaggaattggtcgttaagagtcgaagccgcgtcgcgttcgcttggacattggtcgcattgtgctgcggatcgcacgcttcgcatattttccactccttggggattcacattgctcacggaccgcttatggagattcttcatagttcatacttgaaaggtggtttagctttggggtctctattgggaccaggacgagagttactctttgatggcctaaacgcatttaagaaggggtcgcctaatatgaactctctcgtgggatttggttctgtagctgctttcatcattagttcgatctcgctacttaaccccggcctggcatgggatgcatcattctttgatgaaccggtcatgcttcttggtttcgtgcttctgggacgttctctggaggaaaaggcaaggattcaggcatctagcgatatgaatgaactgctttcactgatatccactcagtcaagacttgtgattacttcaacagaaggttcaccttctactgacactgtgctttgctctgatgcaatttgtgttgaagtcccaactgatgatattcgagtaggggattctgtgttggtgttgcctggagaaactattcctatagatggaacggtcatttcaggaagaagtgttatagatgaatccatgcttacaggggaatcacttcctgtatttaaggagaaagggctcacagtttcagcaggaactataaattgggatggtcctttaaggattgaagcttcttcaactggctccaacactatgatatcgaagattgtacgcatggttgaggatgctcaatcacgtgaagcacctgtacaaaggcttgcagattcaatagcagggccatttgtatacagtgtaatgactttgtcagcagcaacatttgcattttggtattttgtaggatcacacatatttcctgatgttttgctcaacgatattgctggcccagaaggagatcctttgttgttgagtttaaaactatccgtagatgttttggttgtttcttgtccatgtgcactgggtcttgctacgcccacagcaatcttggttggcacctcacttggggcaagaaaaggacttcttattaggggaggggatgtgctggaacgcttggctggaataaattatattgctctagacaagacaggaacccttaccaaaggaaaaccagttgtgtcggccataagctctatcctttatggagaatctgaaattcttcggcttgctgctgcagtggagaaaacagcatctcacccaatagcaaaggctattgtcaataaagctgagtcattagagttggtacttcccgttacaaagggacagttggttgagccaggttttggaactttagcagaagttgatgggcatctgattgcagttgggtctttagaatgggttcatgaacgcttccagacaagagcgaacccatctgatttgacaaatctggagaatagtttgatgaatcattcattgaatacaacatcttcaaagtattcaaaaactgttgtctatgttggacgtgaaggagaaggcatcattggtgcgattgccatatctgacactgtgcgtgaagatgctgaatctactataacaaggctcaagcagaaggggattaaaacagtcctcttgtcaggagacagggaagaggcagttgcaactgtagcagatacagttggaattgaaaatgattttgtcaaagcatctttgtctccacaacagaaatctggatttatttcctctctgaaagctgctggacatcatgttgcaatggtaggtgatgggataaatgatgcaccctctttggctgtggctgatgttgggattgctctgcagaatgaagctcaagagaatgctgcctcggatgcagcatctatcatacttctggggaacaaaatttcacaagttgtcgatgcgctagacctagcacaggcaacaatgggaaaagtgtaccaaaatttgtgttgggcggtcgcatataatgttgttgccattcccattgctgctggtgttttacttccccattttgactttgccatgacaccgtcactttcaggaggactgatggctctgagctccatcttcgtggttggcaactcactgcttctacagcttcatgggtctcagatctctagaaaggttgggtcaactatagaaatcatatcttcccattcgaacacagatatgcttaatttaaaataaccatcggagttgtgtgcattatagagtaagccgtaatatacgttcgagcacagatacgctcaatgtaaaataatcatcggagctgtgcattattatatagaatattctactctcatgaagtatcctagcatgcatttagtatattttcttatacttttatcatgaacggtaactgtgacggaatattataaatcaattagtttcaactgaatgacaaattaattttaaatatatattttatctttagaat

SEQ ID NO: 108 - DNA, 3172 bp, Glycine max
  misc_feature (1)..(3172): Glyma.07g157400.1
tctcttcttcctaccctaattcccaaaaaatgaggtgtccattaatcaccactccacataaatctacacattaggtaagcaacatcaaggatctggcatcttgcacagctatctctacctttcccacaaaacaaaaaagcaattcaaagttcaaattctgaagctcttagttcataaatttcaaaccccacccaaccaaaatttcaaaaccggaaaccaaaaatttcccaagtgtccatttcccctccaatgcatcttcttccctccaaatcaccatttccaatgcttcttcttcttccaatctaaaccctacccaacaccaccaccacctccacctccaacaagaacaccttcttctataacattaccaccatgaattttctcttttcacgggaaaaccttcccccacctccgggaatcccaatccccgccaccattgccgccgccaacaccaccccaaacccaattctaatcccaaagctcgaacctttcgacgaattgctcaacacccacacaccccaacaacaacaacaatctcaggaccccagtttttcaaatgggtcccttgacctcgacctcgacctcgacctcaagctcgtctgcgacgaaacccccggtgctttctctggcgacccaagcttgctctcagatttcaaccgtctctctcagcttttcaaaaccgctttcaccaacaacaacgccgttctcgaccccatcgcccaagggctccagcagctccaaaacgacgctgtttccgaccctctagacggcactaccgttgttccaccgcagagcttccaaaattcggaccccgggatgcagcagcagcagcagtacccgaacggggccgtttcggacccggattcgcgggcaattgtgccggtcccggaggaagggcggtcctcttcggtggcggtcaccacgccgcggcagcggcgcttcaaggagctggtccgcctgacggatgtcggcgggccggagcaacggcacttccgggacgtggtccgccggacgaggatggtttacgactccctgcgcgtcctggcgacggtggaggacgagggccgggtggatgcccgccgggggcgcagcgatctgcgcgcctcggcggtgatgaggaactgtggcctgtggctgaaccgtgacaagagaattgttggtgcaattcccggtgtctgcattggtgatgtgttcctttataggatggagttgtgtgttgttggccttcacggtcagcctcaggctgggattgattatctccctgctagcatgagttccaatggtgaaccaattgccactagtgtcattgtttctggtggttatgaggatgatgttgatgagggtgatgttattatttactctggccatggtggccaggacaagcattctaggcaggttttccaccagaagcttgagggggggaaccttgcaatggagaggagtatgcactatgggattgaggtgagggtcattcgcggagtgcggtatgagggtgctgcctctgctactgggaggttgtatgtgtatgatgggttgtatagaattcatgagtgctggtttgatgtggggaagtcgggttttggggtttataagtataagctgtgtaggattgatgggcaggctaagatggggactgtggtgatgaaggaggcgcttatgcttaggaaggatcccttgagtttcaaacccacgtgttgtttgtcgcttgatgtttcaaataggaaggagaatgtggcggttcggcttttcaatgacattgatcctaactatgaccctctgcagtatgagtatcttgtgaagacaaattttccgcagtttgtgttccatcagagcgggagggggacaggttgtgagtgtgcggacgggtgtgttgaggggtgcttttgtgccatgaagaatggaggggattttccttataatcagagtgggattctcttgagagggaagcctttggtttttgagtgtggcccattttgtcgttgtcctcctcattgtcggaaccgtgtcacgcagaaggggttgaaaaataggttggaagtgttcagatctagggaaactggttggggagttaggtccatggaccttattcaagctggtgcttttatatgcgagtacacaggggttgttctgactagggagcaagcacggcttttgactatgaatggtgattccttgatatatccaaatcggtttactgataggtgggcagaatggggggacttgtctatgatagactccaattttgtgcgtccatcatatccgtcaatacctcctttggattttgccatggatgtgtcaagaatgaggaatgttgcttgctatatgagtcatagttcaactcccaatgtgttggttcagtttgttctgtatgatcacaataatttgatgttccctcgccttatgctatttgcgatggagagcatccctccgatgagagagctcagccttgattatggggtagctgatgagtggacaggaaagctctctatatgcaatgaatgattttgaaagtttcatacactttataatatactgaagctgactttcgggcattgtttgcagagatagtcaagttgatgcagcacaagttttcaacactgccaatttacaaagagcagtagtagaattgcttgctatacgacggtgtcaggaaatcaaaattcaaatataaagaaatgtctattacgttattctggtttttatctaactgtcaatggctagtacacggtgctcctctggtgaggaaggtcaagaattgaagttcccatttctgcttaatcttgaagacttcagtagttttctcacttgttgatgccatttgtttgttctgtaattgttgatgtcttcctcagctcggcgaagcattttcaaatcacatttttgtaagcaataatagtgcaagctgtattaactctttcttcttttggagaacttgtttgtatatagtataatttcaaagcttgtaaaggttttataatagtgactggtatcggatgcaacattttaattaatttagaagcgggtaaattgggcatctggatattaagattactaggatatagccattgttgctaatgatcttgtatgaggaaaatcaaattatgatgaaatggacaatttggttgttatgaatttaacccaataatgtagtagaacaactatggtaaagaaa

SEQ ID NO: 109 - DNA, 3779 bp, Glycine max
  misc_feature (1)..(3779): Glyma.17g037600.1
cgctcccgggaaagtgagggaaagcacgagaaagcttgcgaaaatttcacgttcttctatttgcaaacactgattttccattcaattactgctattattatcaattattattattttgctgtgatcaaattggtttatcgtattaagaattttcattattattattactgttgagactttcctcaagtcttgcaccaaagaactgggttcccagttttctccaattctagggcaactttttcggctaaatccctttcttcccatcgaagcgagctctcattgcaaattaaacgcgctttgcgtgctgcgatcttggttgtgatggaaactagggcataaattggccgtgcagaagaaaaaaagcgtttaaagaatgttcttcagcggcgatccttttacacggaagcgtgtcgatttgggaggtcgaagttcaaaggaaagggaccggaaaaacctgttagaacaaacacgagttgagcgcaaccggcgcttatggttgcgccagcagaactctgctgtactcaaaattcagaaatgcttcagagggagaaaagctgtcagaactgaacaatccaagttgcgagagcagttctataaaatctatgggaagtattgccagaatgtggacaggaattcttttggtccagattctaatttcctctgccagttcctctatttctttaaggcagaaaatattgaggacttcttagttcttgtgcaaatatgccggttgctttggtggtctgttcaggataatggggatgttgtcaaactttttgcgggggtggattattcatccacacgggctttggtgaactaccgagtgaagctatttgtacaagcttgtatttgtgctctgcatcagaatagaaatcagttaaaagatcagcttttattgactcctgaggaattgaatgtgtcagctattcctttattggaggttttagtattgttaattgatcccaaattgccatggagctgtaacctagtacaatatctcattcaaaacaatggagttggcctactcagagagatagttcttactggaaaggataatgcagaaaattgtttttccattggcaagggatcatcattggagcgtgtgcttattgctgtaatatctcatgttggtcagaagccatgtatctgttcacatattaatccaagatatagctctgcatcacagatcatcacaattcctttcttgtggcatctcttcccaaatttacaacagatttttgcagcaaacaacctgaatcaatgttacattcatcaaatggcaaagtttgggcaaaatctgatcaagttgctacctaaggatatatcaaatgaatttccgagccatgcgtgtatgcttggaaatgtattagaaactgctggaattgctttgtctcatcctaactgttcatttgatatggccgtagaccttgttgctgtcactacgtttttgctggaggcactcccatctctgaaaacttccaatagtagagaaagctctgtgattgctaaggatgatatgattgaagacgatgaagtcatggaaatagctttagatagtaaattggagcagcaaatttataatgccataaatcctcgcttccttctgcaactgacaaatatactatttaaagagatttcatctgtcaatggctcagattatggacccaatgatagagatgttacagctgttgatggggtttgtgggtttttgaatgttaccttcaacaagctgccacttgaacggattatgactgtgcttgcttacagaactgaacttgttccaacactttggaattttatgaagcagtgtcatgagaaccaaaaatggtcatcacacctctcaaatgatgcacctggttggctgttacctcttgctgtattctgtcctgtctacaagcacatgcttatgattgtcgataatgaagaattttatgagcaagagaaaccgctatcactgaaggacattagaagcctcatcattatattgagacaggttctgtggcagctactgtgggtgaatcatatcacatctgctaattcggtaaaatctgttccagttagttcagctagtaaggggcagtctgttcagaccattcaacagagggtttgcattgtagtctctgagcttctctcccagctgcaagattggaacaataggcggcagtttacatcccccagtaacttccatgctgatggggtgaatgacttatttagctctcaggctgtaatagaaaacacacgagcaaatgaaattttgaaacaggcccctttcttgataccatttacaagcagggttaaaatattctcttctcaactagctgctgttaggcaaaggcatggacctcaagctgtattttctagaaatcgattcaggatacaacgagatcatattttggaagatgcttacaatcaaatgagtcagttgacagaagatagtcttcgaggatcgattcgtgtgacttttgtcaatgaatttggagttgaagaggctggaattgatggtggtggaatattcaaagatttcatggagaacatcacacgtgctgcctttgatgtgcaatatggattatttaaggaaacagcggatcacctgctttatcctaatcctggatctggaatgatacatgaacaacatttccaatttttccacttccttggtactcttctcgcaaaggctatgtttgaagggattctggttgatataccatttgctacatttttcttgagcaaattgaaacaaaagcacaactatttgaatgacttgccttccttggacccagaattatatcgtcatctcatttttcttaagcattataagggtgacatttcggagttggaactatactttgttatagtaaataatgaatatggagaacaaacagaggaggaactgcttcccggaggaaggaacctacgtgtcactaatgagaatgtcattacttttatccaccttgtagccaatcaccgcttgaattttcagatacgccaacaaagttcacatttcttgaggggatttcagcaacttatgcagaaggattggattgacatgtttaatgaacatgaacttcagcttctgatatcaggttcacttgacagcttggatattgatgatctgcggctgcataccaactatgcaggaggctatcataatgagcattttgttatggagatgttttgggaagttctcaaaggcttttcattggaaaacaggaagaaatttttgaagtttgtgacaggttgctctcgtgggcctttgcttggtttccgatatcttgaacctatgttttgcatacaaagggcttccggtaatgccgttgaagaatcacttgaccgattaccaacatcggctacttgtatgaatctactaaagcttccgccttatacaagcaaggagcaattggaaaccaaattactgtatgccataaatgctgatgctggctttgatttaagttaaaaggaggcagtggaatttacgatatctgtagatttgaaggcggtagaaaatgactcacaaatgaccattgtcagtggaatgggaaacgacaaataatctgatggatagaattgaataaaaatatcctgtgtgcgagtgtatgtatatatattcttattcaatcttcattctcaatttgtctcttttctaaatgtacatatctaaattgtgaattattttgtaaagttcactctttggcagggtttttcctgattattttggatgattattataacaaaactcaacagggaggttgtaatttgcattcagggtgagtttggaaatt

SEQ ID NO: 110 - DNA, 5076 bp, Glycine max
  misc_feature (1)..(5076): Glyma.09g259200.1
gacaaacacaaacacaaaaagttcatcgtatatgggcccacacctctaccaaactgtcccaactctcacgtattcttcttcctcttctgccacacaccaaacaccaccaacaacaacgtcgtaaaagttcttccctttcactttctcacaatcccatagtaaccttctcttctttctgccactttttctcagtctttaatggctgcccgcatcaaaattccgcgttaaacaatcgtgggccggtgcaagttagcatttttcttatcttttgggatgtcaaaaagatacccaataggaaaagtcttttttcttcttcttttggggtgctttttttttttgtcaaatttgattccagtttcaccctccaaacattgttctgtgagaatatagtgtttcacaaggcattttttttttctctttctctatctttttgtgtcttagtgaaagtgaaactgaggctgagggagagttttaatgatgcagattggttttttgttttgtgttagagtttcagtgagaatggtgtgcaagagttcacagttgagtgagaatgtcttgggaaactcctctatgatgatgtgttgttgctaacttactggggaactacttggatgcttcttctgtggtgaaagaagataaaatgcactgttgatcatggttcagctatgctgaaattatggagttctgcttgaatcggtgattgtgagatttggatttgacagtgctggggtcaagcttttgtgtgtgaagcttttttttcttttcttgttattatcaaacttttccattacgtttaatcattcaactttctttttcccctattggaagaaagggggggattcactgaataagggtggctaggtgtctcaattgccttttttttctttaatgggaagagtggactgcaattttcagcttttttctgtggaacctgttctggttatggtctgtacatgaagaaagaaggcattgatacctttccctccaaagaaatcttatattgcttctctgagattcactcgttagggaaacttgggggagtgaaattagaattcctagatgctttgagagtgaactcaccgagctgcatcttagccttttgctccttcaggatgttgagttaaaaacagccgggattataggtacttagttcaatcaatcatattttcctataaattttcagttttttcttacttgcctgaaatgcctaaccactcaattaagttgcatcttcttaggagttataagattgacttggtggtaaaaagagaagggagggagggaaaggtcgtgggttcgatttctcctgctaacaaaaactaaaatttgccgatccaaaaaaaaagctttcagcttcttccattttcagtagaaaccctgatttttgtgctctaaggagttgatggttcagatgatcaactgttgtgcaagattacacctgtgaggagtttgtatgaacataggcaacataaggtcaatattaccttattagcatccctagaaaagggaaataaggaaaaacggaagtgaactgcaccaaccgatcattatggcaaagaggtcccaaagattccctgtgaattatgagaaagatcagtcaggatgtatgtggggttttattagtatatttgattttcgtcatgcccgctttactcggaagttgatcgcggataggaggcatggcagcaagcatgctgttgctgctgcacttaccaagaacaagttcgaagtgttgagcaatttagatgaagaatatgaaggcaatattgacagagtagagagtaagagactaataccagcaactgatgctgataagcttagtgtaaagaaactcatagaagaagagatgatcattgaccaggatgaaataaaggatcaaggtaatgctgatgtagaatcaaagcaatccagattagggcatgaagaccccccaaagaaagaatccaaaagaaaaaagaaatctcgcaagaaaagccgtgatatggatagtcatgatttgaattcagctgcaaccttgaaatctgaattttcacataaacagcattcaagacaacagtcaaaagataatctagatttggacaaaataatgaatgatttttgtcatgttgaagctgcttgttccatgatgaatgacaatgatggcaaaattgatgcacagtcaaaccaaaagcatgctatctctgaaaaccttgctaatgcaatccatgaatttgcaaatcagatgagattgaatgggaaagatctgcctgaagatggacaattcctgagctcacgtgaactcatggaagcacttcaggttataagttcagataagcaattgtttcttaaacttctacaagacccaaattcacatttattgaaatacattcaggagttggaaagtgctcaagggagaggtggtaaagaatgcagttcagttgtcagctccaactgctctgaacaagaacttgttaatctgaaagaaactagggagatttccaaccgcaagcatcgtaactttttcagaaaaagggtgaagtctcaaccaaaagattcaacaaatgaaaatgggaaaactgaattttcaaatagaattgtcattctgaaacctgcactaacaggcatgcaaatttctgaaagtggaaacaaccttgcctcatcactagattctcatgacattgcccagtacaggaatccttcagtgagagttggttcacatttttctcttacagagataaaaaggaaattgaaacatgctatgggaaaggagaggcatggaaaccctgaattgatcccacgcaaactccctgttgaacgtcaaaataaggtgccaagaggcaaatgcaaagataatgctggaatgagatctcctaataaagaccatttcttcattgaaaaaattgcaagacctatgtttgatgttgtgaaaggaaacaagactggtacattgaaagactctgaattgaatgtggaacatgaaagtggtattcccaaccaaagtgtttcaaacatatatattgaggctaggaaacatctgtgtgagatgctagataatgctgatgagagcacaaacatttcaagcaggcagatgccaaaaacccttgggagaatactttctcttcctgagtacaacttttctcctctagaaagtcctggaagggatttagagcatcattctgtgactgcacaggcaagattttcttcctcagacaaaactagggagattagtgaggataatttgtcccccaaaccagcaacatgtattggtcttgcagatcaggaaatcaacaagtcagagaagcagtcaaacatttgtgatgaaagctctaacaataaagtacaagaaattaagacggtgtcgaatctctcccatgatgttgatcatgtcgatacatctgaagcccgttatcctgttagagatgagatagttactgaaggtaatgtagaatctgcgaaagagaaaaatgatttggaattgtccttgaatccaaatggcttcatcacaggaaaggaccaaaatattgatatctcggaaattcctgatggtgcaggatgttctgaacgtttgaatcaggacataacagaagagaaccagccatcatctccaccgccatctcctcacttttctgtcactaagaaaattgaagagctagaaaatggtacagatgtatctgagcgaccgagtcctgtatctgttcttgatacatcattctcggatgatgacttttgccctgggcactccagatgtgagcctgttaaattaccagtacaagcccgacaaattcaatttgaagaacatgactgttcacctccagaacaatttgacagaggaaaatattgttttgaagaaagtgaattgatatatgactacattaaagctgtcttgcatgcctctggcttgactacggatcagttgttgatgaaatgcctttcctcagacaagatactggatccttccttgtttgatcaagtagagtacttctcgaacctgctttgccacgatcagaagctcctatttgactctatcaatgaagttctcatggagatttgtcagcattactttggggcctcaccttgggtttcatttgtaaatcctagcacgaggctaactccaagtatgaaaagggttactttaaaggtctgggaaggagtgtgctggcatatccttcccttgcccccaccgcgcactttagagcaaattgttaggaaagacatggcaagaagggggacatggatggaccttggacttgatgcggaaacaattggttttgaaatgggtgaggacatacttggtgaactgatggaggacaccattttgagccttgtgagtgaaagtccagaaagtaaatgtttctctgcttctatttgagggaaagaacaatgagaacagcttccacttgtaaaagacaactcactgccttttgatcatgcaagatgttaaaggaattcatatgtgtgaggtgaaatgaaagtagataggggatgaaaatcgatcagaaagaataatagagttatagacttctttaaagcatacttggaccttggtactgtttcttttcaccctatctgactattttgatattggattagtataatgtgaacaaggatacaaaaaataagtcacaagaagtaaatgaggagccagtggcaattgcttcttgcaaaagtgaaaagctaagcttgtttacaatgacaaacagacaaagcaacagttttattcagtgtgactcacttcacccagtgaaggccaaaggtgtttgattgtagagtttgtaaagtttgatttgctgatcccattagatggtgtgttgtaattttgtttgtatcatcctttgtatatttgctttttggttaacctattgacttcacaaagtttggaaataatgtacactcggctatctgtggtttcggagtgaagaactgagcagaaatatgaatgacacgtgagaataaagaaacttagaaagctgcagcatgccttaaaaatgccaatgtgaattattgttcttggtttcgcttcttttcctgcctgatatctttctaacggacatgttcaatatattatcatggacttttaaaactaatgcaattatcaac

SEQ ID NO: 111 - DNA, 3117 bp, Glycine max
  misc_feature (1)..(3117): Glyma.18g082200.1
aaaaaacagagctagctagcaagactgaaatggcagaaactgcagtgtccttggctggtcagcatgcgcttccaaaaatattggaagccgtcaaaatgttgagagatctcccaaaagaagttagagacattacagatgaacttgaaagctttcaagatttcatcaatgatgctgataaagtggctgaagccgaagaagatgatggaaggcgtcatagaataaaagaaagggtgatgcggctgagagaaacagcttttcacatggaagatgccatcgatgaatatcacatctcctgtgaggataagcaacctgatgatcctcgatgtgcagctttactatgtgaggctgttgccttcaccaaaactcaaatccttctccttcaaagtgcgtataagattcaggatgttaaatcccttgttcgtgctgaaagagatggtttccaaagccattttcctttagagcaaagaccaaccagttctagaggaaatcaagatgtcacctggcagaaacttcgaatggatcctctctttatcgaggaagatgatgttgtggggcttgatggccctagagatacattgaaaaattggttgacaaagggaagaaaaaaacgcactgtcatctttgtggtgggaattcctggggtgggaaaaacaactcttgccaagcaagtttatgaccaggtgcgtaacaatttcgagtgccatgcattgatcacagtttctcaatcctactctgtagaaggattgctgaggcatatgctgaatgagatttgcaaagaaaaaaaggaggaccctcccaaggatgtttctaccatcgagtcgttgaccgaagaagtcagaaactgcttgcgcaacaagaggtatgttgtcttgtttgatgacgtatggaatggaaaattttgggatcacattgaatctgctgtaattgataataaaaatggaagtagggtattaatcacaaccagggatgagaaggttgcagcatattgtaggaaatcatcatttgttaaggtgcataagctagaaaaacctttaactgaagaagaatctttgaaattgttctgtaagaaggcatttcagtatagttccgatggagattgtccagaagaacttgaagatatatctcttgaaattgttagaaagtgtaaaggtttacctctagcaatagtgtccattggtggtcttttgtctcaaaaagatgaaagtgcacctgaatggggacagtttagtcgagatctaagtttagacttggagaggaattctgagttaaatagcataacaaaaattttaggtttaagttatgatgatttgccgatcaatctcagatcatgtttattgtatttcggaatgtatccggaggactatgaagttcaatctgatagactgattagacagtggatagctgaagggtttgtcaaacatgaaaccggaaaatctttggaagaagttgggcaacaatatttatcagggttggtccgtagaagtttggtgcaagtatcctcacttagaattgatggcaaagttaaaaggtgtcgtgttcatgacttaatacacaacatgatacttggaaaagtcaaggatacaggattttgtcagtatattgacgagcgtgatcaatctgtatcaagtaagattgttcgatgcctgacaattgcaaccgatgattttagtggaagtataggaagctcacccattcggtcaatttttattaggacaggagaagatgaagaagtatctgaacacttagtaaacaaaatccctacaaattacatgctattgaaggtacttgattttgaaggttctggtttacgttatgttcctgaaaatttggggaatttatgccacttgaagtatttaagcttccggtatacagggatagaaagtctatcaaaatccattggtaagctccagaatttggagaccttggatataagaggcacagatgtgtctgagatgctagaggagattacgaagcttaaaaagctacgtcatcttcttagttactatatatcttcaattcaatggaaggatattggaggcatgacatccctacatgagatacctccagtgattattgatgatgatggagtggtcattagagaggtaggaaagctagagcagttaagggaactgacagtgacagattttacgggaaaacacaaagagactgtgtttcttgataaatgagatgccactcttggagaaaactacttattaatacagctgattggagtgaagtaattgacttgtacattacgtcacctatgtctacacttacgaagcttgtcctatttgggaagttaacaaggttgccaaattggatttcacagttcccaaatcttgtgcaactgtattgaaatcactaaaaagtatacattgaaatcacttaaaagtatgccaaggttaatgtacctccgtttcttttacaatgcttatgaaggtgaaacattgcattttcaatgtggagggtttcagaaactaaagcaactgcaactgggatctttggatcaattgaagggcatccttatcgacagaggagcactgtgttctgtggaaaaaattgttttagaagacctctcccaactcaaaacagttccctctggaattcaacacttggagaaacttaaaaatctctctatcagcaactcgtcaactgaatttgagcagcgcattgatcctgatggaggagaagaccactggatcatccaagatgtgccccatgtacgtatttggaggacaagaccacgtcaacaagctttacttttctttctctataactagaagggaagcacggagggaagattgtaagaggtgttccaaatccaatgtttctcacttccaatcatgtgatttattaacttttaattattatgtccattttagcgttattaacaccaacacaatacgaagaagttgaaaatagtgttcctacaaagacagacaattttttacaacgggaaaactcaagattccctcaagttctttcttttacagcccgtgaaatggtggatgcatgagtggatttgaggcatcaaattgattttttaagcttccttcttctctttctcttgtttcccttttttctaaaatgtgtacctcaatttttgttaacttgata

SEQ ID NO: 112 - DNA, 1759 bp, Glycine max
  misc_feature (1)..(1759): Glyma.08g271700.1
atacgcaaacgctcgaaacaacaacatttgcggttctgcctgcaaattttcttcccctcaatcgtatattgctcaggtggtgttcctgttcccccccaagcacccctgagattcgttcgcaaaaagcttaataagaacaaaaaataaaaataatattcttcgttattatttcatttcaatttcgttttcgttttcgttttctgttttgatttgatcttccaatggcgtccgatggctttaccgacaagaacaccgtgttcagaaagctcaaggcgaagtctgaaaataagatgtgtttcgattgcaatgcgaagaaccctacctgggcgtccgtcacgtatgggatctttctctgcatcgattgctccgccgtacaccgcagtctcggcgtgcacatcagcttcgtgaggtctacaaatttagactcatggagtcctgagcaactaaaaacaatgagctttggaggaaacaatcgtgcacaggttttctttaagcaacatggttggaatgatggtggtaaaatagaggctaagtacacatctagagctgcagacttgtataggcaaattctttcaaaggaagttgcaaaaagtatggctgaggatggaggcttgccttcatcacctgttgcttctcagtcttcccagggggttaatgggctaccagaagtcaagaccaatgaagtgccaaaagaaaacattctggagaagccagaaaagcctgagagcacttcttcccctagagcttcacatacagtaatttcaagtaccgttaagaaacctattggtgctaagaaagcagtgaagagtggggggctcggcgctcgtaaactcactaaaaagccaagtgagtctctctatgagcagaagcctgaggaaccccctgctccagtttcatcttcaacaaacaatatgcctgctgggccatctccaacgtctcggtttgagtatgtagaaaatgtccaatcatctgagttgaacactggaggttcacatttgcttagtcatgtgtctccaccaaagtcatcaagcttctttgcagactttggaatggatagtggctttccaaagaaatctgggccaagctcctccaaagtgcaaattcaggaaactgatgaagcaagaaggaagttctcaaatgctaaatctatttcttcatcccaatattttggagatcagaacaaggctgcagatgtggattctcaagctacattgtctaagttttcgggttcaagtgccatctccagtgctgatctttttggtgactcaagagacaacaacattgatcttactgctggtgacctcatcaatcgattatctttccaggcacaacaggatctctcttcccttaagaacattgcaggagagactggaaagaagctgagctcattggcctccacattgatgacagatcttcaggaccgaatcctctaaaatgtgtatgctctgtatttaagagaatctttggagttttttacatatgccagccaattatgtttcaaatgtaatagaagagttttcaatatacaattctttgagaaaataagatgctatattttcaggcttgtcatatagacgggtgcttctattttgtataacaggtactgcttagatgttgctaatgttttagatttattcctttttttttgggttagtcgataccagtttgtggtgaactcgtgaactctaaaagagtgtttacgtcagcttctatcagtgaaatagttttcttgtttacatttataaaccggcttaccttt

SEQ ID NO: 113 - DNA, 1356 bp, Glycine max
  misc_feature (1)..(1356): Glyma.18g133400.1
gggtgccccaaacagttgccaaaattcggggcttatcttggaacccaaggcccaatcatcccacacgacaacaacaccctaaatcttaacaacatttcagtctctcaccgtcctcccactttgcctctttctctccgtgtggccgttcagtgacaccgagtgtaaagaagaggagagaaaccgagaaagaagaagaaaactagggttttgcaattgctgcaatggcgcatcaaggagaaccggcgaagctgcggtggggtgagctcgaggaggacgacggcgaggatctggacttcctcctgccgccgcggcaggtgataggccccgacgagaacgggataaagaaggtgatcgagtacaagttcgacgaggacgggaacaaggtgaagatcaccaccaccacgcgcacgcgcaagctcgccaacgcgcgtctcagcaaacgcgccgtcgagcgccgctcctggcccaagttcggcgacgccgtccacgaagacgttggtgcccgcctcaccatggtctccaccgaagagatcctactcgaacgccccaagcctcttggtgccaagtcagaggagccaaagaatgctggagacccattggctcaatttcagaaaggtgctgttcttatggtctgtaggacttgtgggaagaagggtgatcactggacctcaaggtgtccatacaaggatcttgccccgccatctgagggattcgtcgataaacctgcggcggcagacactgtggcagccactgctggtgcaaccaagggagcatatgtgcctcctggtatgagggcaggtgctgagaggactactggatctgatatgcggcgcaggaatgatgagaattctgtgagggtaactaacctctctgaggacacgagagagcctgatttgctggagctgttccgtcctttcggtcctgtcagcagagtctatgttgccattgatcagaagactggcatgagcagagggtttggctttgttaactttgtcaacagggaagatgcacaaagagctattaacaaactcaatgggtatggctatgacaatctcatccttagagttgaatgggcaaccccaagggcaaattaaatgttgaatgtttttgcctctttctttaaaacggtattttgaaggtctttctatttttgtagtctgagtcctgtactatctgtttcctttgagatgatttattatttaaaagtatacattcattctagatctcatgttggtcattgataatcaggtatcatctcacctataaagtatcacattttggaagtgaaaatggttgatatttcttagcctacaggagttatggtttatcatttttcttcttcctaagcatgctgtg

SEQ ID NO: 114 - DNA, 2050 bp, Glycine max
  misc_feature (1)..(2050): Glyma.06g140200.1
catttaatccaaaaggaatttgtaacattttccttaaattaattaaatatcttgtttctggtccaaaccttagttagtgtcgtactatcagctttccgtggcactgttgtttagttatttcagtgttgctggtagttgtattgtagtattatatccgttttgtaaagcataaagctttaagctgataggaaattggaggagcgattggggtgagatgatgatgatggtaaggatagggatgttttatggggaactgggttcttctactctttgtttatcccatcgctgcaataactctacactttcacatatacacaaacatccctctcctctaatatctccaaactatgctgctactcacactcacaacaaacgattagttgcttctgcttcttcagctccatcagttagcggttcaggtgctgaatattccgagcagatggtggatgtgggagcaaaaaagaaaaagaagagtatagcaggcatagatcaggacgaattagtggatccaaagcttttagctgatctagacagttgtttttgtgagttcaaaggagtgcatatacaccacaagatatgtgatgccgaatcaaaagcacaaagcacaccccagagtcggactgtttctcatcaaatcaagaagctaggttatcctatgattttgttacatggatttggtgcctcagttttctcatggaaacaggttatgaagccgttggccgaggttgctggttcaaaagttcttgcttttgataggccagcctttggattgacatcaagggtaaatttatctaggcatccttcttcagaaacagaagacgcaaaacctctaaatgcatactcaatggcattttccgtgcttgctaccctgcacttcattaaattactaaatgctcagaaggtgattttagtggggcactcagctggttcacttgtagcagttaatacttattttgaagctccagaacgtgttgctgctctgattctagttgccccagcaatttttgccccacttactacacggaaagttgttaaagaaaatcaatcaggacatgataaccaaacggaagaagacaacagttccatcagaaaaaatccaattttggggctttacaagatgttgtccaagactaccaagtacattgcagaggcaatatcacagatgatgaagtggacaatagatatcctcaacttttggtacagaaaattgttatcagctatcctgcgttcttcccttgctataatgctggtaagaatggcaattgataagttcggtactactgcagttcgaaatgcatggtatgacccaaagcaggttgctgagcatgtccttagtggttatataaagcctttaaggattaagaattgggatagggcactggtggaatacactgcagcaatgcttctggatgaggaatctaaaacaaagccatcactttctaaaaggcttcatgaaatatcatgtcctgttctgattgtaactggtgatactgatcgaatagtcccttcatggaatgctgagagactttcacgagtcataccaggagcatcttttgaagtaattaagcaatgtggtcatctgccccatgaagaaaaagtggaggagttcatttcaattgttgaaaacttcctaaggagattagtgagtgattcaaacgaacaatatctacaagaagcaactgcatagaagatataatataggcagacgctaatgcagtttgataaaatggacaaaattcattgaaggcatattgatgcacacgcgttaaattcatcaagctcgatgatctctatctagaagttggaaaaatgctgataagcaataacctgtaactcattgttacactatattactgctagcttgctatagtacttgaagaaatcctctttatgtttacctgaatgaatgatctgtaactacgttcatatcgtaggccattgaacctagcaaagacgtctctcagatgtaaaaagacttatcatttaacaagtgatctctaaattgtttatttgatgttgggatgtggataactgcaggcattgcagttca

SEQ ID NO: 115 - DNA, 1874 bp, Glycine max
  misc_feature (1)..(1874): Glyma.08g044900.1
gcattaaaaacataggtgatgtaacatccttattaaacaaaactgacgcaaaaagaagacaacaaatatgaattaccaattttacccttaggagaaacgaaaatgacatgacatcctctgatctgatctgtgtggcgaagtcgcccttgacgacgactcagcgaagctgaactgagagtggagcttcgtccacagggaaacgcataagcatatcggaattccggggaagaaagaaagaaacataatgtgttcttcggagactatcaacatcgctgcgagtacacagaaacttgatgttgataatcgaattgctctccgcttctactacagaatcgccgataatatcctcaaacaggctgatatctttcgtgcagagacaaatattgttgatctgtatatcatgctcctaagattttccagtttggtctccgagacaatacctcgtcaccgagattatagatcatcttcacaaggcaaaaaagaagctttgagaaagaaactgttacattctgtgaatgagctagagaaattgaaaccgaaggtgcaacagaagatcaatgagtttaacagcaggcgagcataccaacacaatgggtgggaaaaatatcattcaaatgattttatggatttttctccagcaaaaaaggcagtcataccaaccactggagagtttgtttaccaaggatcaaggggccagcagttttctagtgcaaggcctgtggaagagaatatgaggagactatctctaagtctcccatgtccaaaggaggaaactctctctagacattctgttctaggtcccaatgggctgaaagggcagtggcgaccacctgcaagtgataaaggggttaggtatccaaccatcatagatctgtctccagttgaaattccaagccttcaacattccttggaagatggatctctgaataaaaaagataatagcatttcagaacaacataaatcagatttagaatcaattcttacccagagtgatgactgcaaggcaaaacatgctgatgaagctccttctcttatctcttttgaagcaacagaagtccatgctcaaatagaagttaccagacagccttctcctccacctgtacttgctgaagtaaaagatttggttcctgcagtgttatctcatgttaatgaggaaggatgtaagacagagattctaacatcagatagtattgttcgtgctgagtctccactgcaactacacatttcaacttctatgatggagagttttatgaagcttgccaagtcaaacactgataaaaatttagagacttgtggaatccttgctggtttgcttaaaaacagaaaattttatattaccgctctaataatcccaaagcaggaggcaacatccagttcttgtcaagctacaaatgaagaggagatatttgaagtacaggataagcaatctcttttctcccttgggtggatccacacacatcctacacaatcttgtttcatgtcatcaattgatgtacacacccattactcttatcagattatgctgccagaagctgttgcaatagttatggcaccaacagacagttcaagaagccatggcatttttcggttgacaacccctggtggaatgtcggtcattagacaatgccagcagcgtggctttcatccacataatcaacctccagatggtggtcccatttatgatacatgtacagatgtttacatgaacccagatttaaaatttgatgtcattgatcttcgatgagaagggttatatcacccatgcatgttcattattttggtcaaatcctgaactttctatgattgttatatccgcatcaattaaaagtacctggtagctccaatttatggggtgaatcaaatataaaacttca

SEQ ID NO: 116 - DNA, 1840 bp, Glycine max
  misc_feature (1)..(1840): Glyma.06g141300.1
atgtattcattcaaccagccagccagccactttccttttttctcatttgttctcttacttttgtctctccaaaaaccattctctttctccgatctctccgccatttcctacgaacctcagatggaggactctgaaaaatttgatgcaggtagtgaccaagggaatgcattggtgactccatattataccccatatccgaagcacttgttaccgaaatctggccttcaacctgtcaatatagagttttctcctagctcaggcggtgataactctgtggcctctatgaaagagggccctggatcatcttcttcatcatcctcatcatccacagactcagagcaagaaaggaaaatagttggggaggaaaaaacagataatgtatcattggagagtgagaatagaagttacaatgagttgcttaaagaattccttaaaaataaggaagagctgaaactttccaacatcaaacttaagctctcagaagaaaagatagtcaagttgaatgttcaaattgagaaaagtgagggtgagcttaataatgtgttggtagaattaaaagtgaaagaagaaaatctcgagtatgaaaaaggacaggtactggagttgcaaaaaaagacagctgatttggagacacatgttccagattgcagcctcaaaatagcaaagttagtggcacagctggagttggctgaagaacagcttaagatatcagatgatgaaattgcaagattgaaagaggaacttaatagcaggtcatctggtactcatgaattgcaaggtcagcttgaagtagcacaggaaattgtggccgcattagagagccaacttgtctcagagagaaagcagattcatgacctagaaggcagggttacatggtacaaagctaatgaaaccaacactgaacatgcggtgcaaaaattgaaggccaaaatgcttgatgcccaagcacagttctcattggagaaagatcttttgcattctgatattgctcgtttgtcagaagagaacaaacagctgggctctagacttgaggaatatgagtctagaagcaacataatagaaaacaaatcaaggcaacttgaagcggaaaaactgaaactagaagagctgcttgctacccaacaaatggatttgcaaggtgaaatcagttgtttgaaggaagaacttgatcagagaagacatgatgttgaagctgtgaataaggaatttgacaggcacaagcagaagtgtgatgtgctcatgactgaaaaagatgaggccaatgctaagattcataaccttatggctgagacaagagaccgaaacaattacattgcaaatctggagagagatataatcctgctacgtggacaagaggcagagctgagcacaggatctgcagctacactgagacttgtaaaggagttgaaactaaaagccgatgggctcgaaaaagaggtgattctgaagaatgctatgatctcagacagggctgaggagaagagggaggcaatccgacaactatgcttttcaattgagcactataggagtggttataaagaacttcttcaagcatttgctgggcacaagtgtcatgccgttacagctgcctaaagttgcattcacctgtgtctcatcgttttattgtgttgtagatctttgcgcattaacaattttgcatgtcgtttcccttattcttgttgagcatctatacattgcataaaactgtcttcctatcgaattaggtcaaacatttacattggtaattgaccttgatgaaatctctacattcagttctcatagtcttggtttctgctgttggtttgaaggacaccattctatattcatagtctagactttc

SEQ ID NO: 117 - DNA, 2008 bp, Glycine max
  misc_feature (1)..(2008): Glyma.18g237100.1
aaaaacaacaggcagatttgctccacactctttgctggcctctcctctcaaccttctctctcttacatacttttcttcatagtgctaaattttctattcatctcacattctcactctcctcaattctttttcttttctcttctctcttcttcaacttcattcaaaactttcacctttctctctcttcacaaacggtgccggaaaagtccattctttttctcaattccccggcaaaacaaatgcgacccactttctagaacctcgccgtgtgccggaaagttcactcctttctcacttttccgcagcaatgtcaatcttcgacggagctttcatgaacacgcaactctccaagcacacttcgatcttcggcctccgtctctgggtcgtgatcggaattctcatcggagtcttcatcgtcttcacgctcttcctcctctccctctgccttgtctctcgccggaaccgccgccgctccggcgcaggcaccggctacaaggtcgccggaggcgccgacgcggcgaaggacatccacacgatcgtgcaccttcccgggccccacatgctccggcctccggcgccggagatccacgtggagatggggaagaagacggagcaccgggtggtggtgcagtgcgatagggtttcaagtgaggagagtaaggtcacggtggggagtgggtgtgaaacgacgtcgtcttttggaagtgggagtgttggtgggcctgggcctgggcttgggcctgaggtttcacatcttgggtgggggaggtggtacactctgagggagcttgaggatgccactggagggttgagtcctgaaaatgtggttggtgaaggtggctatggcattgtctatcatggggtactcaatgatggtaccaaaattgctgtcaagaacctcttgaataacaagggacaagctgagaaagaatttaaagtagaggtagaagcaattggtcgagtgcgacacaaaaatcttgttaggttgcttggatactgtgtcgagggagcctacaggatgcttgtgtatgagtatgtagacaatggcaatctagaacaatggctgcatggggatgttggagctgtaagccctttgacatggaacatacggatgaacattatattgggaacagcaagaggattggcctatcttcatgagggtcttgaaccaaaagttgtccaccgagatgtgaaatcaagtaacatactcattgatcgccaatggaactccaaggtttctgattttgggcttgctaagcttttatgttctgagaatagttatgtcacaactcgagtgatgggaacatttggttatgttgcaccagaatatgcatgcaccggaatgctaactgagaagagtgatatttatagctttgggatacttatcatggagataattaccggaagaagccctgttgattatagtagaccacaaggagaggttaatttaatagaatggttgaagactatggttgggaatcgaaaatctgaggaagtagttgatcctaagctccctgagatgccatcttcaaaggctcttaaacgcgctttgttgattgctcttcggtgtgttgatcctgatgcaaccaagaggccaaaaatgggacatgtgatccacatgcttgaagcagatgacctgttattccatactgaacaaagaactgagggagagtcttcccgttcctatcaaagtgagcaaagggactcaaatttagataagagaagagatggaggtgccaatgataaaagtgaagatgctagtactagatggagatgataacaagctgataatttaatggaactacgtgcttattttttggtctctattagtttgccaattcttgtgtgtaggttaatttaaaaaaatgatagtatctttttttctctctttattatatagttttccattgttgttatcagccccagcttgggattcatattcaagtgtatactctgattcgttattataaaaataaaaatatttatgactatctgttcacaggacaat

SEQ ID NO: 118 - DNA, 1023 bp, Glycine max
  misc_feature (1)..(1023): Glyma.12g230600.1
ctttctttcttcctttccttcttttcactacttgtctcttccctttttctttccagaacaacagaacaacagagcaaaaagctccaccaatggcgggttacagagccgacgacgactacgactacctcttcaaggtggtcctcatcggcgactccggcgtgggcaagtccaacctcctctcgcgcttcaccaagaacgagttcaacctggagtccaagtccaccattggcgtcgagttcgccacccgcaccttgaacgtcgattccaaagtcatcaaggcccagatctgggataccgcaggccaagaaaggtatcgtgcgatcaccagtgcttactatcgtggggcagttggtgcacttcttgtgtatgatgtcactcgccatgcaacatttgaaaatgttgacagatggctgaaagaattgcggaaccacacagacgccaacattgttgtgatgctagttggcaacaaatcagaccttcgtcacctcgtagcggtgtcaactgaagatgggaagtcctatgctgagaaagaatcactttacttcatggaaacctcagctctggaggctactaatgtagagaatgcatttgctgaagttctgactcaaatctaccgcattgttagcaagaaagcagtagagggggctgaaaatggaactgcatctgtgcctgccaaaggagagaaaattgatctgaaaaatgatgtgtctgctttgaagagagttggttgctgctcaagctaaaattggaaaacatagttcaattggttggtatcggctctgttgtatgtgtaatattctgagaaatacgaactagaagaaaagtgaaatttaatttgtcatagcatgttagactctttgtgtaaccttaaaaactaagtttggtgtttcaataggagctgctggtgaagcaagttgattgctagtcttacttgtagtgctgttattgtttttgaaatgttttcacatgcaaagtggttcaagcttggaattaattgaagctattgcttaatttaagtttttg

SEQ ID NO: 119 - DNA, 3428 bp, Glycine max
  misc_feature (1)..(3428): Glyma.03g219500.1
ggcaatggaaatggcagcttacttactagtacctagcaacagtagcagcggatataccgagacggagatagaaaaaatataacgcaggaatcgaattcttaattttatcagatgatgcgacttcacaaactgtatcatcgcttcactcttgtccccctttcgctcccttctaatccctctcttcttcctctcgctcctccgttgcgcctcacgctccgtcaccgaacctctgtgaacttcgcttccatggcttcctcgcggttgcgcaatttagcacctctcgctgctgcgcccactgaagacgccgccgctgcctccatttcttcctctcccaacgccgctgcttccgttgactacgatgatgagtcaactgtaggagtaaggtatcgcgttcctccatctgtgatcagtgatattgttgatgctccacctgtacctgcgttgtcattttcaccacttagggacagaattatttttctcaagcgaagagctttacctccactggcagaaatagcaaggccggaggaaaagttggctggtatacgtattgatggaaagtgcaatactaggagtcgcatgtcattctacactggtatagggatccatcaaattcttcctgacggtacattagggtcagagactgaggtgtccggtttccctgttggtgctaaaataaattttgtttcttggtctcctgatggttgtcatttgtcctttagcattcgtgtgaatgaggaggacaatgatagcagtaaactcacagtatggattgcagatgtgaaaacagggatagctagaaagttgtttcagtcacctaatgtacatttgaatgcagtttttgacaattatgtttgggtaaataattcttcattgttagtttgcaccattccatcatcccgtggagctcctccaaagaaacctttggttccaagttgcccaaaaattcaatccaacgaggagagaagcattattcaagtaagaacattccaggatttgctgaaggatgagtacgatgaagatttgtttgactactatgccacctcacagcttgttttggcttctttggatggtactacaaaagaaattggcccaccagctgtatatacctccatggatccttccccagatcacaagtacattttgattaattcacttcacaggccatactccttcattgtaccttgtggaagatttccaaagaaggtagagttatggagtgctgatggaaaattaatcagggagctctgtgacttgccccttgctgaggacattccaattgcattcaatagtgtgcgaaaagggatgcgttccattaattggagagctgataagccgtctactctttactgggtagaaactcaagatggaggtgatgcaaaggtggaaatttctcctcgtgatataatttatacacagcctgctgaaccactagaaggtgaacacccaacaatattacacaagcttgatttccgctatggaggggtttcttggtgtgatgattcactggctttggtatatgaatcttggtacaaaacacggaaaataagaacatgggtagtctctcctggatctgaagatgtagctccgcgcatcctatttgatagatcttcagaagatgtgtactctgatcccggttctcctatgatgcggagaactcaagctgggacatacattattgccaggataaagaaggaaagtgatgaaggaagatatattatactgaatggaaatggtgctacaccagaaggaaacattccattccttgatctgtttgacataaatacaggtaaaaaaatggaacgaatctgggagagcgataaggagaagtattatgagactgttgttgctctaatgtctgatcaagaagaaggggatttgtatttagataaactgaagatactgacttctaaagagtcaaaaactgaaaacacccaatactactttgttagctggccagataaaaacatagttcaggttacaaatttccctcatccataccctcagcttgcatcattgcagaaagagatgatcagatatgaaagaaaagacggggttcaacttactgctacattatacctaccaccaggttacaatccatcaacagatggccctttgccatgcctggtttggtcttacccaggagaatttaagagcaaagatgctgctggacaagttcgtggttctccaaatgaatttgctggaataggctccacatcagcccttctttggctggctagaaggtttgcaattctatctgggcctaccattcctattattggcgagggtgatgaagaggcaaatgataggtatgtagaacaattagttgcaagtgcagaggctgctgtggaggaagttatccagcgtggggtggctgatccgaagaaaatagctgttggtggacattcctatggtgcgttcatgactgctaacctgctggcacacgcacctcatcttttttgttgtggaattgctcgttctggtgcttacaacagaacacttactccctttggttttcagaatgaagacagaactctttgggaggccactaatacttatgtagagatgagtccttttatgtcggctaataaaattaagaagcccatcttgcttattcacggggaagaggacaataatccaggaacattaaccatgcagtcagacaggtttttcaacgctctaaagggtcatggtgctctttgtcggctggtgattttgcctcacgagagtcatggttacactgctaaagaaagcatcatgcatgtcctttgggaaacagatagatggctccataaatattgtgtgtcaaacagctctgaggcaggagaagaccatgctactgatacagtcaaagaacatgttagcaaaggcaccacaaatgctgaaagcaaagtggttgcacccagcggaggcggcagcagagaggtgtctgatcttgagtacgaagaatttcattctctgccgaggtcatccttgtgaagaaagatctgatttcggactgccaaagactagaatagaagcatccaaatgatgcatgtggaagacccagcagcaagatgcccttcactgtgagaacggaacacattcaaattggcaggtatcacttgcattgcaagttacggggcactccatgatatcatgtattcctttaaaaactactatagcaataatagcattgctggtgcagtgacaagttgccaaaatatattcatgatttaacaggatgattcataatctgtttctcgtgttttcagaaggctccttagcagcctagctgaataatttcacaaagcaatctaatatacttgaggaataaccacactacttattcttcctatgccatttgagcttgcttctgatcttgccttcctaattgtggagttgtgattctttttagtgcatatacaattgtactctaacggcaaatctag

SEQ ID NO: 120 - DNA, 1769 bp, Glycine max
  misc_feature (1)..(1769): Glyma.08g138800.1
caaatttgaaatgaatgtgaaggtgaagaagagtttcaccaacccaccccaccccatcccaccaaactccctctacctaccgctattcaacctccttcttcttcttcttcttcttctcatctttcttatttttcagtaaccccttctctcccaaaatctccctctgttcagtttcaatatggcgaacacactatataacggcgccacatgccgaatccctctccgtgatgaatccctggccttctctcgccacgtttccagatccctctctttcctcctcaaaacacgtgcgggaaaacaatcatacgcatttgcggttaaggcttcttcgcactctgacttcgacgttgacctttcgctcagtccacgtgtcaatgccgtcaagccttccaaaaccgtcgccatcagcgaccacgccaccgctctcttccaagccggcgttcccgtcattcgcctcgccgccggcgagcccgatttcgacacgcccgctcccatagctgaggctgggattaatgcaattcgcgaaggttacacgaggtacacgcccaatgccggaaccatggaactgcgccaagcgatttgtcgcaagcttaaagaggagaatgggattagttatactcctgaccaagttgtggttagtaacggagccaaacagagcattgctcaggcagtgcttgcagtttgctcccccggagatgaggttattattccagctccattctgggttagttacccagaaatggcaaggttggctgatgcgacacctgtgattcttccaaccttaatatctgataatttccttttggatcccaaacttcttgaatccaaaattactgaaagatcgagactgctcattctttgttcaccatctaacccaacaggatctgtctaccctaaagaattacttgaagagatagcccggattgttgcaaagcaccccaggctcctggttctctccgatgaaatttatgaacacataatttatgcaccagcaactcacacaagttttgcatctttaccaggaatgtgggacagaactcttactgtgaatggattttccaaggcctttgcaatgactggttggcggcttggatatattgctggtccaaaacattttgttgcagcatgtggaaagatccaaagtcagttcacttcaggggccagtagtatagctcagaaagctgcagttgctgcattaggactaggccatgctggtggggaggcagtttctaccatggtgaaagcatttagggagcgaagggatttcttggtaaaaagttttagagaaatagatggtgtcaagatatctgaaccccagggagcattttatctattccttgatttcagcttctattatggaagagaagctgaaggattcggtaaaattgaggattctgagtccctctgtcgatatctactggatgtgggccaggtagccctggtgccagggagtgcatttggagatgacacttgcatccgcatctcttatgcagaatcccttactaccctacaggcagctgtagaaagagttaagagagcacttatcccgctgagctctgctgcacttgtttaatattgctgttttgttgtaatgggtgtattttatttttattttaattttggcaatgtgtaatctgtttattctgaaaatattaggctttggatattcttccataaaatgaagtgatacaactgtctttaatggtttaaaattataacaacaaaattgtcctccttttatgtaacatatgtctcgaagcgaaggggaa

SEQ ID NO: 121 - DNA, 2100 bp, Glycine max
  misc_feature (1)..(2100): Glyma.07g029200.1
gggtgggcgtgtaaactaaacggacaggggatatttggatttggttttctttcaccggcggcgaaggtaaggtggtgcaaacaaacaaaaaaccctaattctcgaatatcagatcggcgatcggaggaagaatctgaagttgggcgaagatggttctcgcggagttaggagggagcatttcgcgtgctcttcagcagatgagcaatgcgacgatcatcgacgagaaagtcctcaacgattgcctcaacgacatcacgcgcgcgcttctccaatccgatgttcagttcaagctcgtccgcgacatgcagaccaacatcaagaacattgtcaacctcgaagacctcgccgcaggtcacaacaagcgcaggatcatccagcaggccgtcttcaacgagctctgcaagatcctcgatcccggaaaaccctcttttacccctaaaaagggcaaaaccagcgtcgtcatgttcgttggcctgcaaggatctggcaaaacgacgacgtgtacgaaatacgcgttttatcatcagaagaaagggtggaagcctgctctggtgtgtgcggatacgttcagagctggtgcttttgatcagttgaagcaaaacgctactaaagcgaagatccctttctatggaagctatatggagtcagatcctgtgaaaattgctgtggaaggggttgaacgattcaagcaagaaaactgtgatcttataattgttgacactagtgggcggcacaagcaagaagctgctctttttgaagaaatgcgccaagtttcagaagcaacgaaaccagatcttgttatattcgttatggatagcagtatcggtcaggctgcttttgatcaggctcaagcatttaaacagagtgttgcagttggagctgtcattgtcactaaaatggatggccatgcaaagggtggtggggctcttagtgctgtagcagcaacaaagagtcctgtcatattcattggaactggagaacacatggatgaatttgaagtttttgatgttaaaccatttgtcagtcgtctactaggcatgggagactggtctgggttcatggataaaattcatgaagttgttcctatggatcaacaacctgaactgcttcaaaagctgtcagaaggaaacttcaccttgaggattatgtatgagcagtttcagaacttacttaaaatgggtcccatcagccaggtcttttctatgctaccaggatttagtgctgaattaatgccaaaaggccgtgagaaggaaagccaggcaaaaattaaacgttacatgacaatgatggactcgatgacaaatgaagagttggatagttcaaacccaaagctcatgaatgagtcccgaatgatgcgaatagctcgaggttctggtcgtccagttagggaagtaatggaaatgttagaagagtacaaacgtcttgcaaagatatggagcaaaatgaaagggcttaaaatacctaagaagggtgaaatgagcgccttatcccgaaatatgaatgctcaacacatgagcaaagtcctccctcctcagatgctaaagcaaattggaggcatgggtgggttacaaagcttgatgaagcagatggggtctgctaaagatatgatgggaatgtttggcggtggtggtgattagtagattggctgtggcatatgagctgaggattgtttctgatctgtactacaaactctaatacttcacaagaactcatcgttgtgaaattatgctgttcacatggaattcggatgtattgttttgtcaatcaacctgcagcatctcaatggtggaaatagttcctttcaattttaccttaagatcctttcttctgtaaaactaagcccccttattttcctttttctgtatatttttgtctttaggtgaagtcaaagcaattttatagcgaattggaaattttcttgtagttgtaacattataaataagttatatattgctcctctctgaatatattgaataaggtgaagttaattctgacagtagttttgtatttgcaattcatgagtgaaatgtggttaatcacattagcctcaaccagacattaacccagtctaatattatatccatgtgtctttgattgctt

SEQ ID NO: 122 - DNA, 1648 bp, Glycine max
  misc_feature (1)..(1648): Glyma.06g216700.1
tcactccctcacgcttcctggtttcctcactcgacaccgctcaatgtttcctttgtctccttcttacatttacttgattacatcccctccgttcatggaccaatatgctcaagcttcttcttccatcctcatcctctaaactcatctccagacacattttctcacaactatcacgccccaccaccaccatgtccataaatctacgcacccacgccttcgcgggtaacccgctccgatcccccaaccgggtcgacccgttttcgcccgcctccgcgctcgagaccctcacgacccgaatcctcgacgccgcgcacgtgtcctcaccgtccgtggattttaaggtcttgccttttagaaatgggagggtgctggcttcttcggagagtggtgacacgtggcgcctcgggtggatcgcgctggaggaagtgaagggtctattgggtgcggatttgagcgcggactcgttcgtttatttggggtcagactcggactcagactcggtggtgtactgggcgatcgacgtgtcgagggagagtgggttggtgacggaattcagtggcgtgaggttgtgcttcgtggagctcaggacgctcatggtcgctaccgattgggtggatttgaagaccatggggaacctcgccatcgccggtcatgccagggcacttcttgaatggcataaaatatcacgattttgtggacattgtggagagaaaacagtccctatggaagctgggagacgtaaacagtgctcaaatgaatcatgcaaacagaggatatatccacgacttgacccggtggtcattatgctagtaattgatcgggagaatgaccgtgcccttttgagcaaacaatcgagatttgtacctagaatgtggagctgcttagcaggttttatagagccaggagaaagcttggaggaggctgtaagaagagaaacgtgggaggagactggtattgaagtgggagaagttgtatatcatagctctcagccatggcctgttggaccgaatagcatgccatgtcagctgatggtggggttctttgcatatgcgaaatcccttgaaataaatgtggacaaagaagagttggaagatgctcagtggcacagtagagaatatgtaagaaaggctctgacatttgctgaatacaagaaagcccaacaaactgcggtagcgaaggtagaacaaatgtgtaagggagtagaaaaggctcacagcttgtctaccgatttcaatgtggaaagtggtgaacttgctccaatgtttgttcctggaccctttgcaatagctcatcaccttatttcctcctgggcattcccagatcaaaatgtaaatggcagtgaatgtcattcaaaacaggctagtggttctatgtcaaatttgtaggagtgcaaattatttttttaaaggcacctttgattttacattgttttccatactaaactgatgtgagatataatcaatcaccataagactgactgcattatgttgcattttctttgttgggcgtagaaacataaattgggcagttgaattgtttagggtttttttatgtgtaagaattaaataagatatcaagagatttataacatttacatatctggttcaatcaactgagttaaaccccctggttgaactggttgaattat

SEQ ID NO: 123 - DNA, 2920 bp, Glycine max
  misc_feature (1)..(2920): Glyma.04g065700.1
gacagttaggtgtagctgtttctttaactttctcctttttttctccctcaattgagtcccaaagcaaacgcactacactctacagtatagagagagcaccacaacacaatacgagatgagaattgttttttcattggatagaacacgtgtacactatacataaaacaaacgcactgcgctcgtggcttttcttagccacgttgccgcttctactcttaacgtgcgcccctccaccgtacccaccacggcacagattccgccttgtccgatccgatcggcgaaacccttgtcctcggcggtgccgtcactctcataatcccgattcctaccactgagctcagataatcatattatgatcttcaaattgtagagagacagagaattctaggctgtgacgacgacgacgaagaagatgcagagacgaagtcctccgaagcacaggcacgacgggacttcgccgctgcctctcggcatggattggagccctgcgcctcgaaaatggaatgggcgagatacagtgtggccacacaatcatcttactggttggagttattgtgtcacaataccttcttgggcctttgttccaaaatcaaggaattcagatcctatagtgttctacagggttcaagttggtgtacagtcaccggaagggattacaaaggtccatggagtcttgagaaggttcaatgattttctaaagttgtttgctgatattaaaaaggagtttcccaggaaaaatatccctccagcaccacccaagggactcttgcggttgaaaagccgagctttgttagaagagagaaggtgctctttggaggagtggatcaccaaactattatctgacattgatatatcacgatgtgctgccgtggcgtcatttcttgaactagaagcagctgctagatcttcattccaagatgcaagccagcagaattctgaaacagaccccgattccaataacacagtttattctgtgcaatcacctctccagtcgagtttatcattattcgctggcagttcatctgttgcctcagattatggtagtgatactgcatatgagccatctgacctaggaacaccaagaattggacgggacgataattctgaagttggcacagatgatctaacattagatgaagatatgacgaatccaatagaaaagcttgtgaaatatggcatatcaaatattgacgaaggtttgtttatgggtcagactattctagagcaattggaaggccttcctaggcataaagcaaatgccagacatgtgaactatgctgcagaaaaggtaaaaaataatggtaatgtatatgattcctcacttttagctaataataccatggagcttttctctgagcctgggcatgctaaggttgttgctcatgttcgtaagctttcaagtgagagtgttggaagtgatggaagctcaatacgaggtagtgacatgtctaattttgggattccaaattcatctggtgatggctctcatgaccttcctggatctgctttggtttcaagagagacagatattatgggccacacaaagttgaagtctactggtgatactcaattagtccttccactagatcaacgcaataaattgaacaggattctttcaaccatgcagcgaaggctaggcactgcaaaaactgatatggaggaccttatagttagattaaatcaagaaatagctgcaaaggattttcttgcaacaaaggtcaaggatttggaagtagaacttgaaactaccaaacagaaaaataaggagaacttgcagcaggctattctaattgagagagaaaggtttactcaaatgcagtggaatatggaggaacttagacgacaatcattggaaatggagataaaactaaagtctgaattggggcgaaattcttatcaggatttgacaaaggaatcaattgttcagcagaatgatgtactgttggagaatttagatgctactaaggagcagctggaaattttgtcaaaacagtatggagagctagaagccaaatccaaagcagatgttaaagttctggttaaagaggtcaaatctctccgtaattcccaaacaaagttaaagaaagaacttagtgagtctataaaggaacacagtgaaactgagaaactacttctgcacgaaagagagaagagggagcaggcagaagtggctcggagaatactgctggagaaatgcagggttcttttcaaccagcttcaagagtgcaatgtcagtcttccttacgaatacgaaggtaggacaattgtgaattcatcatcatcaactgatgcttttaatcaattaacgacatctgatgaccaaatggacatcctactagcagaggtagaaaacttagagaaggactacggaagtgcagcttgcaatgtagataaaacgaatgacataaaagatggtgtaatctgtgatgatgaagtgagaaagatcatagcagatttgttcatcgataatgttagattgagaaaacagacaaaccgcgtcacaaggcatgccctcaaattggatatgacagcaagtgatgattccccttcagtggaaactgtaacaagtattgagaaatatatgtgaagtgctaatatatatattgttcttcggcttttgaccaagagcccactgtttcttatcccggtggatgatcatttgccgttcccaataggtgagttaatatactgagtgcagtagctcccctaatgtatttcaacttgtactacgagtttttactttacacacgtatacgagccttgcaccacatttttttatgaacttaaaataatgaaaagccggaactcatcaaaggtaaaattatgtctactcttgcttttttatttttcgttaccattttttattaataaaacacattttatagctgtggtcatggagaagcactggcagcagtgtggg

SEQ ID NO: 124 - DNA, 3334 bp, Glycine max
  misc_feature (1)..(3334): Glyma.17g059800.1
aaagtaagaaaagaaaagagagagcatagcatccatttaatttaatttactaaaatccgaattccgaacaacgcaaacaaaatgattccaataataatgataaacaatgaatgctaattattaattatactaacaacaatattaatatcagttccctgcatcaagattcaagatcagacatgatgctcttacttcactccattgacattcaattcaattaaacaaataaaccaaaccctaacactctcactcacttctaccttcttcttcttctgattccatggctttcaggttcaacagtgatcgttagatcactgattatagcaatgtgaatgaataagtgagtgcattggcgtgtatgtgaatcaagttaacttcacgtgcttttttcttcttctttttttctctgcttccagttggtgtgactgagagcaactgctggctacttggatcagagtgagtggacattgatcttgtaagctgctggagttgggattggttagtgagaaatgagattgttggagtttgggtgtgtgttgattgttctatctgcacttctggtttctggggatgctgaggtttacatagtaactgttgaaggtgagcctatcataagttatactggaggtattgatgggtttaaagctactgctgtggaatctgatgaggagattgataccacaagtgaattggttacttcttatgctcgccatcttgagaaaaaacatgacatgctgctgggtttgctgtttgaggaagggacataccagaaactttatagctatcgacatcttataaatgggtttgctgttcatatttcaccagaacaggcagaaactctaagacatgctcctggagtgaaatctgttgagagggactggaaagtgaagagacttacaacacataccccacaatttttagggcttccaactggggtttggccaacaggaggtggctttgatcgggctggagaagacattgtgattggacttgtggacacagggatctatcctcagcacccaagttttgcaactcataattctgagccatatgggccagttccaaagtacagaggaaaatgtgaagctgatccagaaactaaaagaagttactgtaatgggaagattgttggagcacaacactttgctcatgctgcaatagctgctgggtcatttaacccttcaattgactttgcttctcctcttgatggagatggacatggaagtcatacagcctctattgcggccggaaataatggaattcctgtgaggatgaatggccatgaattcgggagagcgagtgggatggctcctcgtgctaggattgctgtctacaaggcaatttatagactgtttggagggtttgttgcagatgtagttgctgcaattgatcaggctgtatatgatggagtggatatactcaacctttcagttggacccgacagtcctccagcagccaccaaaactacatttttgaacccttttgatgccacacttcttggagccgtgaaagctggtgtatttgttgcacaggctgctggaaatcatggtcctcttcctaagacattggtttcatatagtccatggatagcatctgtagcagctgcaattgatgatcgtagatataaaaatcatttgatccttggaaatggaaaaaccttagcaggaattgggttatcaccttccacacatttaaacgaaacatacacattggttgccgcaaatgatgtgttgctagattcttcacttatgaagtatagccccacggattgccagagaccagaacttttaaataagaatttaataaagggaaatattcttctctgtggatattccttcaactttgttgttggcactgcatcgatcaagaaagtctcagaaacagcaaaggcccttggtgcagttggatttgttctttgtgttgaaaacatttccctaggaacaaaatttaatccagttcctgttggccttcctgggattctcatcatagatgtcagcaattcaaaggaactgatagattattataatatcactacaccaagagactggactgggcgtgtaaagagtttcgaaggtaaaggtaaaatcggtgatggtttgatgcctattctgcataaatctgcaccacaggtagcattattctctgctcgagggccaaatataaaggacttcagcttccaagaggcagatcttctcaaaccagatatattagctcctggttcattgatttgggctgcttggtgtccaaatggaactgatgagccaaattatgttggtgaagcgtttgccatgatatctggaaccagcatggctgcaccacatatagctggaattgctgctcttataaagcagaagcatcctcattggagccctgcagccattaaatcagctttgatgactacatcaacgactctagacagagcaggggatcctcttctagcccagcaaacttctgaatcagaagctatgaggctggtcaaagctactccttttgattatgggagtggtcatgttgatccaactgctgcattggaccctgggctcatctttgatgcagggtacgaggattatataggcttcttgtgcacaacacctagcattgatgttcatgagataaggaactacactcacaccccatgtaacacctccatgggcaaaccatcaaatttaaacaccccatcaataacaatttcccatcttgtgagaactcaagttgtcacgcgcacggtcacaaatgttgccgaggaagaaacctatgtgatcacagccagaatggaaccggctgttgccattgaagtcaaccctccagcaatgactatcaaagcaggcgcatcgcgccagtttttggtgtcacttacagtgcgctcggtgacaggaaggtatagttttggagaggttttgatgaaagggagcagagggcacaaggtgaggattcctgttctggccaacggataccgacgatagatagcatagtgaagtttggtcagcaaaggaaaggaaagcaagtgctgcttgtaatattctttgtaacctgtggggaataaggtatggcgctacatttattcgtctaaatatataaatatgtaatgttaaattatgaataggtgtaaaggtaagcaggtgtaaggggtcactcctagtttcttccacatatagttttgcttatattgtctagtaattttgttggaatgcttcatcacaagttttaacctgtatctgccccattccccaaaagttcgttgcttacagcatgtgtaatacatgaaataatttgtataacataaggtatcaatggcacagcgtaaatcctaccaaagctattggctagttaaatt

SEQ ID NO: 125 - DNA, 3384 bp, Glycine max
  misc_feature (1)..(3384): Glyma.05g030700.1
tgagcaagtggctctaagtatgtatatgtatctacttactataacatgatggcttccttcacaatccataggagtttgtgtttgtgcttttctgtactgtgttgaagagtagtagtagaagtggttcgatccccaacagttagtgtgagagcaaagttggtagctctagagagacacagagaagaagaagatgggggacaagtcccaagttttggaggccgtgttgaaggaaactgttgatttggagaacatacccattgaggaggttcttgagaatctgagatgtggcagagaagggctcagcagtgaagctgctgaggagaggcttaccatttttggtcacaacaagcttgaagagaagaaagagagcaaatttttgaagttcttgggatttatgtggaatcctctgtcatgggttatggaggctgctgctataatggctattgcgcttgcaaatggaggggggaaggctcctgattggcaagactttgtgggtatcattaccttgcttctcatcaattcaactatcagtttcattgaggagaacaatgctggtaatgccgcagcagctctcatggctcggctcgctccaaaagcaaaggttcttcgagatggtaggtggaatgagcaagatgcggcgatcctggttcccggtgacataatcagcatcaaacttggagatattattcctgcagatgctcggcttcttgaaggggatcctttgaaaattgatcaatctgcccttaccggtgagtcactgccagtgacaaagggtcctggtgatggagtatattctggttctacctgcaaacaaggagagattgaagctgtggtcattgctactggtgttcataccttctttgggaaagctgctcatcttgtggatactaccaatcaagtgggacactttcaaaaggtcttgactgcaattgggaacttctgcatatgttcaattgcattagggatggttgttgaaattattgttatgtatcccatccaagatcggccctatcgtcctggaattgataacttgcttgtacttctcattggaggaattccaattgccatgcccacagttttgtctgtgaccatggccattggttctcacaggctatctcagcagggggctatcacaaagaggatgacagccattgaagagatggcaggcatggatgtgctttgcagtgataaaactgggactctgacattaaataagcttactgttgacaaaaatcttgttgaggtttttgcaaaaggagtggatccagatactgttattttgatggcggcccgagcttcaaggcttgagaatcaagatgcaattgatacagccatagttgggatgttggctgatccaaaggaggcacgtgctggcatacaagaagtgcattttcttcctttcaatcctactgataagcggacggcattgacttatcttgatcaagatggcaaaatgcatagagtaagcaaaggtgcaccagaacagatcctgaatcttgcacacaataaggcagacattgaacgtagagttcattcagtgatagacaagtttgcagagcgtggtttacgatctcttgctgtagcataccaagaagttccagatggaaggaaagagagtgctggaggcccgtggcaatttattggccttttgtctctctttgacccacctaggcatgatagtgcagaaacaatacggagggcactaaaccttggagtcaatgtcaaaatgattacaggggatcagctagctataggaaaggaaacaggtcgtcgcttgggaatgggtaccaacatgtatccttcatcagctttacttgggcaggacaaggatgaatccattgttgccttgccaattgatgaactaatagaaaaggctgatggatttgctggtgtatttcctgagcacaagtatgagatagtgaaacgcttgcaagctaggaaacatatttgtggaatgactggggatggagtgaacgatgcacctgccctcaagaaggcagacattggtatagctgttgctgatgctactgatgcagcccggagtgcatctgatattgttctaacagaacctggacttagtgttattattagtgctgttttgacaagccgagccatcttccagagaatgaaaaattatacaatttatgcagtatcaattacaattcgtattgtgcttggttttatgttgctggctctcatttggaagtttgactttccaccctttatggtgcttattatcgctatcctaaatgatggtactattatgacaatttcaaaagatcgtgtaaaaccatcacctctgccagatagctggaagctagcagagatatttactactggagttgtgcttggaagttacttggcaatgatgacagttatattcttttgggcggcatacaaaacaaactttttcccgcgagtgtttggagtcccaagtcttgaaaaaactgctcatgatgattaccggaaacttgcctctgcaatctatcttcaagtgagcactattagtcaggctcttatatttgtaactcgatctcgaggttggtcttatgttgagcgtcctggtttattgctggtgtttgcttttgttgttgctcaactgattgccactttgattgcagtatatgccaattggagctttgctgcaattgaaggaatcggttggggttgggctggtgttatatggttatataacatcatattctacatcccacttgatatcgttaaatttttaattcgctatgctcttagcggtagggcttgggaccttgtcattgagcaaaggattgcattcacaaggcaaaaggactttggaaaggaacaacgtgaacttcaatgggcacatgcacaaagaacattacatggattacaaccagctgacaccaagttcaatgagcgtacacatgtcagtgaactcaatcaaatggccgaagaagctaaaaggagagctgaaattgcaaggttgagagaacttcatacactaaaaggtcacgtagaatcagttgtgagattgaaggggcttgacatagacacaattcagcaagcatacacactctaaagatgcttaatatatttgcatacttatactgtaaagagttacattctaatgttgctgaagaaccatataatgtaatgatcacacacgttctgtcctttttactctgccgtctgtttcgagcacttaaaggagtgcttttttgaggtcaatttatgtcatcttgtttcttgttatcactctacctgtcacgcattctccacaatttcatgatgccatgaatgaagagaaattcacccttgtatcctacgcttctgaactcattttctatctatgtacctcctcaatttctttcatctttggaaattaattataaagttccatgtgaa

SEQ ID NO: 126 - DNA, 1371 bp, Glycine max
  misc_feature (1)..(1371): Glyma.13g289400.1
atggtcatgacagagagcaaccgattaatgaatgaatccaaaagtaaagtttatcatgaacctaactccatcaaataaaacccctcccatgtagtacgcttttattaattgagtatttgctcgcacgtccacaataaactacactgctgccaatctgtcaccatggcggctcttattaaacacctaccccttctcctctctcactctcactctcaccatttttctctcctcaatccattccccactcacctattcactatttctatcatattatagttatagttatagttataacatagcaatagcaaattatatatatacatcgaccacccagatttaatttcactccaacccatcatgcatcaccgtagattcagcaaattaatacatgtggctgacccagatgagcctgagtccgggcccgagcccgcctcagaagctgggcctgcttctccttcttccggtgaagacacaaaaactgaagcaccgtcacccaagaaaaggagggagatgaagaagagggtggtgacgataccgatcggtgacgtggatggatctaagagcaaaggagaaaattatccaccgtcggattcatgggcctggaggaagtacggccaaaagcccatcaaaggctccccttacccaaggggatattaccgatgcagcagttcaaaggggtgtcccgcaaggaagcaagttgagcgaagccgtgtggaccccacaaagctaatagtcacctacgcatatgaacacaaccactccctccctctcccaaaatcaaattcctccgcggcttccgccgctgtaagcgacggcgccacctcctcctcaccggcagattccgccgccaggtacccgccggaggaggagatgaaggtgttcgcgacggactcagacctcgaactcgccggcgacgcggcggttctgctcagccaccaccaccaccaccacttcgggtggttcgatgacgtgacgtccaccggcgtcctcgaaagcccgatctgcggcgaggtggatgacgtggcggtgccgatgagggaggaggacgagtcgctcttcgccgatctcggcgagttgccggagtgctcggcggttttccggcggatgaatattccggcgaccagcgcgatccggtgcggcggcatcacaggataacgcgggtggacccgtttttcttttgtgtcgcgtcattgcgtagtgatttatattatattcgccgcctgaaagtcgtgcgctattaaaaaaaaagttggaaaagtaaagaaataattaattaaataaattaatttataattcatggatttttttttcttgcgttgtacatttgaataaacaattgattacagcaagctaccttcttcttctgcagaa

SEQ ID NO: 127 - DNA, 1995 bp, Glycine max
  misc_feature (1)..(1995): Glyma.15g076300.1
gaaggtcatcatcatcaattcatcatactcactgtcccaaattcctcttaggtcccaacccagtaactatgattccatcggaaaccgttaattttgctcgaaatttcgcagctatggtcagagttcgtggccctgtgagtttctctttctctcttctacaacgccgcctactctattatcaccgctcactcagcttgcaattaacttttcgggacccaaaagggttaaagatgagaaaacacgcttttcatcaatactgttctggtggaacaactctttcagcttctgggatgctcgtacctgataccctttgtgatgctcaagtagctgggtgtctctatggtgataactgtgaggatagggtgttggttgtgacggttgcttcagttgttgagccttttctgtcacctcaacagagagacaatattcctcagggtaggccagacttgatttctggtgttcggattgatgttatgacagaggaagccaatgaaaaatccaatcagggaactccttgttggcttgcggcagagcttttgtcattagttgatattcctgcttcatccaattgtctccagtcacttattgaagcatctttgggtttgccagagcatgaatgggaggttggttggtctttggcatcttacaataatgattctcaaccttccaaagatttttttcaaactcatccttgggaaagattgggcgtgggagtatctggcagtgcaagtcttatgtacaaatcacttactcgaatggcaattttcagtgtttctttatctttcagggacttgctggatagtaaagtatctgccatgaataaaaagggtgattttcttctggcagttggatctccttttggagtcctgtcacctatgcacttttttaacagcatctctgtaggatgcattgcaaactgctatcctcctcattcatctgatggatcgttgctgatggctgacatacgctgtcttcctggaatggaaggcagtccagttttcagtgagcatgcatgtcttattggtgtcctgattagaccattgagacagaagacgtatggagaggaaatccagctggtgattccttgggatgccattgtgactgcttctagtagcttgctgcgaaagaggcctcagaacacacagaaagggttatgtaatcaggggaaacttttatgctgcaggaagggattcttcccatctgtttgctctggtgtggtagcaaaagtggttgaggcaaagactcctcaatcttatctgtccattcaacctgagcatctgcacaaccatgagcacttcccagcaatgctcgaaacaacagctactattcatcctggtgctagtggtggtgctgttatcaattcagatggtcacatgattggcctggttacaagcaatgcaaggcatagtggaggagcagtaatacctcatcttaattttagcattccatctgctgctttggcacccgtcttcaaattctcaaaagccatgcaggatttatcacttctacggattctagatgaaccgaacgaatacctttcatctgtatgggcattgatgcggccatcatatcctaatcctcatcctatgcatgatccacctcagtctgttacagacaataaaaataaagagaagggttctcggtttgctaaagtttattgctgaaagaaaggacattttcaattctggaaaaagtggagtgatttctaaggaagttattcctagtaagttatgatctctgatgaagtgacaaagtttacctgaatgaccatggcaaagctttgccagcatacaacttgtcaatgtgtacacttcctatgattaaaatctttgaactgaaatcttctgccttggattgttagccaaagaaaaatcaaggaaataaattttctagaacctctaaacgattatacttgtactttattaaagtttaaaactgattttacataagacagttatttttgtcttataggagaaactcttgatggagttattt

SEQ ID NO: 128 - DNA, 785 bp, Glycine max
  misc_feature (1)..(785): Glyma.07g156500.1
gatttttttaacctttcacctttgacattcaacagttgcagagtgaaacgatgccgtgcctcaacctctccaccaacgttaacctagacggcatcgacacctcttccattctctccgaagccacctcaactgtcgccagcatcatcggcaaacccgaggcctatgtgatgattgtattgaaaggatcagtgcctatatctcatggtgggagtgagcagccagcagcttatggtgaattggtgtccattggtggtcttagccctgacgtgaacaagaaactcagtgctggcattgcttcaattctcgaaaacaagttgtctgtgccgaagtcccgattctacttgaagttttatgacactaaggcccatcagagtcaagaatatgcacaatgtttgcatgctttacaccagcactaggtcatggttccaattttggatggaatggatctacattctgaattccgagttatcttggtaacgatgccatggatgtcggatgaactcgtgattctgttttagaactttttttatctgtaaaaagtactctgaatttcatataccccctttgaggacattatgccatggtaattggattatgttcaaggacaactgggggtcctatatgtataagatgcaatcactggacaaacattatctggtgaccttaagatgagcgtctttttagtggtgaattagaattatgcatggttaaacttgagactttggtgatacatgacggatccttttgctattattacggtattattttgtagttccaagaataga

SEQ ID NO: 129 - DNA, 1209 bp, Glycine max
  misc_feature (1)..(1209): Glyma.15g177000.1
aaagaaaagaaaaagaaagagcatcaggcagagccagccaggtaagcaagcatatgcaggttggcaaatggagtttttgcctttctctctcccttgggaggagagagagagagagagagagagacggaggaaatgacagactggcaataaggaggacgaccctttggtatttggatcttcaagaaagagagacccttgggatttcgtcaccatgagtctcttcggtcttggaaacagaaaccaaaaaacatttcgtccaaaaaagagcgctccatctggaagtaagggtgctcaacttcaaaaacacatagatgccacgttgggtagtgggaacttgagggaggctgttaaactgccccctggtgaagatattaatgagtggctagctgtaaacactgtggacttctttaatcaagtgaatatcctgtttggtactcttacagaattctgcacgccaagtaactgcccttcaatgactgcaggaccaaagtatgagtatcgatgggctgatggtgttactataaagaaaccaatagaggtgtctgctccaaaatatgttgagtatttgatggactggattgaatctcagctagatgatgaaacaattttccctcaaagattgggggctccctttccaaccaatttccgagatgttgtcaagacaattttcaagcgactattccgtgtatatgcccacatttaccactcacattttcagaagatagtgagtttgaaggaagaagctcaccttaatacttgcttcaagcactttgttttatttacttgggaattccgtttgatcgacaaagtagagttggcacctcttgaggaccttgttgaatctattattcagttatagtgctgttggtgttttctttcccttaattttggggagatattaaacattgaaaaagttggttatacatttttgtacccccttgtaaaaatacttgctaaatgaaaaatctttatcaccccttatgtatttggctcttaattgttgtgatggttgctcaataacaataatcgtgtgaatcaagcgaaaacctgcttgtgcggcaaggaaaataatagatgaactgaagctttgtattttttggcagatgttttagagtcctcttttgtttttctcccctccccctaaattaataaaggctaggggaacataatggctttctgaacagaacaagcaattggatattttatcca

SEQ ID NO: 130 - DNA, 2081 bp, Glycine max
  misc_feature (1)..(2081): Glyma.01g038600.1
  misc_feature (1441)..(1540): n = a or g or c or t
acaccatagttaaacactaaaaccctaccaaagcaaacccacccctctatatatcacccaaaccaacccaagtctcattctctttctctccatcagaaagaaaaactcaacacaacaccccctctccaccctctttttcttttaatttctcatcttatctattaatcttatatacatatatataaagacatagataatagtcatatagatataattatttcgttatattttccttgcatgggctgttaagatgtctcgcacgtgctcacagtgcggcaacaacggccacaactcacggacatgcaccgacggtggcgccgccgggtctccgagggagaacggcatcatgctgttcggcgtaagagtcatgacggaagctaactcctccttcaggaagagcgccagcatgaacaacctctcacagtacgacgcggagttcaacgccgccgacgccggctacgcctccgacgacgtcgttcacgcctccggccgcacgcgcgagcgcaagcgaggtgttccttggacggaggaagagcatagattgttcctgttagggttacacaaagtcggaaaaggagattggagagggatttctagaaacttcgtgaaaactcgcacgcctactcaggtcgctagtcacgctcagaagtactttctccgccgccacaaccagaatcgccgccgccggagatctagcctcttcgacatcaccaccgatacggtgatggaatcttctactataatggaagaagaacaagttccgccagagacggtggcggcgcctctccccgccgcatatccgccgtcgcattacggggcttttgccggcgcgggttttccgatagctccggtggtgttgccggtgagtggcgagagactaaccaagccgatcaggccgacgccgattttgccagtgcctccgtcttcgaagatggctaatttgaacttgaaagagaaagcttctccgacaaatctcattgagcctttgccgttgtcgttgaatctgccatcgccgacgccgcggtctcaggatcagtcgtcggcgagtagtgggcactcgtcaccgtcgtcgtcgtcatcggcggcagcttttcaggctatgtctgcagcgaagttcggcagcggcggggatagtatcatcagcgttgcttgaaaagaaggaaacaagaaaaaaattagtgtcattaagttattaattaagtatggtcttagtagttaatttgcgtgtgtaaattaatgttacttaatcgggcatgtatccaagagggggaaaaattgaagatatgtgtcggggatttatcgattattacgaaagatactcataatataggtaggacggcggggatatttgaattactgagtattatggtaattacttatgacttggaaaaataactatatactatgggttaaggttatgtcagtacttaggcaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtattcgaatgcacacatctagaccactatacgttgaatgaaaagaatacaacaaaaaaactcttggttgaaattggagatagtgtaatgattctcaattgatgatttcacaagtttagtgggaatactaagttaaaaaacccaatcttaagaaatatttcgagttcataattaaagaagatatgtaaatcattcgagtgggttaaaattccatcatattccagagtaaaaagtattcaagtcgatgcactatctcagtatctcagctagctagcactgaaatgataggaaaccataaatccacaatccaaaggagcttattaaagcccaacgtgttgattgaagaagttgtgatgagatgaaaatccaaactcaatttatatgaatatccgaaaaaaagggagctaccaaaaaggagggaaggaaaatatagagacaagcaatgtggtagtcaatagtgaatggaatttgttgtgattcatatgtatttgatttagcatttttagggatatgttaatctatatatacatgttttatc

SEQ ID NO: 131 - DNA, 3068 bp, Glycine max
  misc_feature (1)..(3068): Glyma.05g041600.1
aaagcggctaacgggtacgctagcgctagcaactctccaaattcttttccgaagaagaagcctcgtctccgattagggttagggtttcagtgttctctcttccttccgtgtcactgttacgcttcccttcgtcggtcctcgcttgcgctccgagagctatggactctgctcttgtgatcaaggtgaaatatggagataccctcaggcgcttcagtgctcatgttgatgagaataataggctggatcttgacatggttggcttgagggcaaagatatgttctatcttcagtttcagtgctgatgaaaatttaattctgagatatgttgatgaagatggcgacctggtgactctagttgatgatgatgatttgcgtgatgtgatgaggcagcaattgaagttcttgagaattgatgtacatatgaacaatgacggtggtgataaatcaaatgctggctctagtggaagtgccaccccctcagaaacttgtcctgtcacaagcccatttctgcttagaaatgctatggtacgtgaacatctttctaaaaaagcagcatcttcaagtcctgtggttgataatcttgccaattcaattttgaaaatgggactaaattcccatttccagcctcctgatacagctggtaaaagctcaaaaactggtgttcctgaagaacctatcactaaagcaatgggtccacaatcttcacatgtggactcagcctccaatgctagtgtcaatagtgatagtgctacccccataagatctccaattccaaacccttatctaagtggaaatgctgttaaagttgacgtctcatgttctgtgcccgaaccagtacgccagtttttttccaaatcatcaagttcaaatgctgctgcgtcttcaagtcagctgcctgcaaatctcgctgatttaatttccctagtgcctgaaccagtacgcgagtttctttccaatttatcacattcaaatgctgcatcttcaaatcagctgcctgttaatctcactgatttagtttccctactgggacaatctattctaaattctcattgccagcctcatgttgcaactggtccattcgcaaaaaatggtgttactgaagaacctatcacttctgaagcaagaggtcaacagatcccatctgcagactcggcttccaatgccactcaacaggtggaggcaggagttgccactattgatctcaatgcccctccttttgatccctttttagctcagttcacttgtgaaaataaggctccactttcatcagaagctcctaatggtcatggcaagaagggtaaaatgccgactgtcgatagttctgctggtaagggtgacagtagtgggatatcctcaagttttgctgctcctaataattcaacccagactacatcattgacttctggtgctttcattgaatgcccatttgctgggacatatattaattcttggacaccacttcctggaaactctcaaatgcccccatttaaaaggagccatagtcacactgatgcaatgtctggtatgttccataagggggtccgctgtgatggctgtggtgtctatccaataactggacctcgtttcaaatccaaagtaaaggaaaattatgatctttgcaacatttgtttcaatgaaatgggtaatgggacagattatatcagaatggaccgccctgcatctgctcgggcccctcgatacttacatggacatacaaaaaactttccaacattaccaccacatatttttaagaaaggtgccattttgaagcatgcaaagccaaaactagatagtaggtttattttggatgttaatgtgatagatggtacaatgatggctccatctactgcatttacaaagatctggcggatgcgcaataatggcactatagtctggcacaagggaactcaacttgtttggattggaggagacaagtttagtgactctcattcagttgacttagaggttcctgaggatggtgtccctttggagaaggaacttgacattgccgttgacttcacagcacctccattacctggtcgttacatatcatattggaggatgacaactccatctggacatcaatttggccaacgtgtttgggtccttatacaggttgatgcctctctcaaggactcattttatgataactctcaaggtctgaacttgaatattcccctcgatatcagtggctctaaaggacctcatattatagatatcaatgtccagcctactgaggatgatactgttcttcaaacccgcaagcctaatgctcccattgagcctttgaatcaaatggttgatgaggaaccaaggttggagctggaaaacgaattccctataaatgaagctacatttgttgcccctgttgcctcagccccagctgcaacctctgtggcatcttcatcagtgccttgtcctataattgatctgtctgaaacaaccccagctgttccatctaatcagcaatccccaaccgtggatgtgccatcgtcatctatgggtactggtggaggaattaattctgtggaggagaatctacttaaagagcttgaggagatgggttttaaacaggttgatttgaacaaggagatcttgaggaagaatgagtacgatctggaccaatccctagacgctctctgtggtgttgatgtctgtggtgtttctgagtgggaccatatgcttgaagagttacaggagatgggttttcgtgacaaagagatgaataagagactgcttgagaaaaacaatggaagcctcaaacgtgttgttatggatttaataaacggcgagtagttttagttgaaatgttagttaatagtttatgtaaaggtgacgacttgtgctcctagggtgcctgatacttgcctggcagtcataattatcttatttcctatctcgatcttgagttgtggtgattcatcacaattgaacaatttgatctatcctatgtttggatttaagtatgttatgaactcaaaagtatatagctaaatcattttggttatttataggttaaccctttttttatatatatattgcgctgcatgtgttcaaaacttcaaatcg

SEQ ID NO: 132 - DNA, 3136 bp, Glycine max
  misc_feature (1)..(3136): Glyma.04g116700.1
tagcacgcacatagagataataaaacagcccaagagggtggtggaggggaaggacaaaccaaaccaaacaaacaaaacagccaccgccataccaagaagaagaagaagaagaaagtggttgaagagtttggtggcaaacatggcgatgcgcgacctcgtttcgggcgctgcggcatgtggcgactcttcttcttcttcctccgcaaaccctctcgcttccctcgccaacgcccttattggctcttcctccaaaactccggagaggttgaaggagattcccacatccactcccactgaccctacatcccaattttactccacagctcttcccgccaatcagcttcccggcaccgaactcgataagcctctattgaatgcaaactctcaggcttcggagtttttgcataggttccgtggcaccaccggccttgaggagacgtgggatgagatacagcgtgatggggcggctgcccaaatgcgccaactgccaccggggattcaacagctgccgttggatgggacaccgcaaagagttctatcgagctttttgcattcgtttcttgatagcagccgtggtggagtgccttttcatcctgctccgctaccgatgttgggtttatctgatggtgataaacaatgcatccgtgaccgcagcagcataatggctaggcatctctttgcggataaaggcgaagaatttattgatgcccaagtaaatgcgcttctatgctctctagatattgacagcagtgtccgtggtaagggacctatgcctgaaagattccgggagcttgaggattactggaatgagtctcaaggcaacctgagacttggtcctcctgctccagacgggtggatttctgaatttagtcaacatagggaaaaatatgataatcctgattcatgggctaactcatttgagcaacagtatggtgcaaatggttgggtgtctgaatttgaacattcccaattgtcgtcagtagatcaaatgcgaggtatgaacatgccaaactttgctgcaatggagcagactcgtatgcttgcaaacacgttggcccaaaatggtgaccctaaatttcagaactcaaaattccttcaatttgtatcaaagatgagccgtggtgagttgattattgatgacaatcaagttaaagagaatgcattacctgcatctggagattgggcaacagaatacaatcagcaatataatcatggtcatgcatgggctggagaatttttaaatgataaggtttatcatggacctgatcagtgggtgaatgaatttacaagtgaaggacagcagcatgatgcagttgatgatcagtgggttaatgaattctcaaagttgaatgttaatgattgggcagatgaatttggtcagcagtttggtgaaggagccttaggggataatagcacttctgatagttgggcacaagcgtatgatgagttcctaaatgagcaagtggctgccaagcagcagttagacagttcaaggggtgtgtatgtcttctcagatttaaatccttatgttggccatccaaatccgttaaaagaaggtcaagatctattcagaaaaggacttttaagtgaagcagttctagcattggaagctgaagtcctaaaaaaccctgagaatgctgaagggtggagactgcttggaatagcacatgcagagaatgatgatgatcaacaggctattgcagcaatgatgcgtgcacaagaggctgacccgacaaacctggaagtgcttcttgctcttggtgttagtcatacaaatgaactggagcaaacagctgctctgaagtatctatatggatggttgcgccatcacccaaaatatggaacacttgccccgcctgagatggctgattctttgtactatgccgatgtagctaggttattcaatgatgcagctgaactctcacctgatgatgcagatgtccacatagttctaggggtcatgtacaacttatccagagaatatgacaaagccattgcatcttttgaaagagcactgaaacttaagccacaggattactctctatggaacaagctgggtgcaacacaagcaaacagtgttcaaagtgctgatgcaataatggcttatcaacaggcgctggatttaaagcctaattatgtccgtgcttgggcaaatatgggcatcagttatgcaaaccagggtatgtatgacgagtccgttcgttattatgttcgagcacttgccatgaatccaaaagcagagaatgcatggcaatatttgagaatttcgttgagctgtgcttctaggaatgacatgttggaagcttgtgatagtcgtaatttggaccttctccagaaggagtttccactacagtaagggtgcgttttagtgaacagcttaaaagtgcttagtgaataagtacttatcatataagcactaatgtataagttatttttataactgaaggggatatagggttaacttcttttcatataaactgtgagcaatttttataagttatcccagtaagttaattgaaataagatgaaaatagcttatggacacatcataggctaattttataggttctgtcacacacttgtaaaagtgcttgtcataagttcaaataagctattgataagcattttcaaacgcatatgaaattttgactttttctgagttgacgaattacaggagggtcacttccactgaggaggtggttacttgaacatgaatcctaattttccttaaaaacttttggatgagtaaatgacacattttctgccattaaagcttgcagtagatgcctgcttctatagaaatttcttggagaactaaaaggccgatcaagtgattaagcctgctggtgaatacgaggcattattctatcaatcttggaacatatggtgtatatcatgaagtacatcaacctacactggttttaggcactgttacagactccatttcttgatgttacaaaagctatttatcatagaacagctgcagtagtaaagttaagggattgtggctttccattataaagttgagtttattgtgtatgtacatatatatacaagtatacaagattagtcgcatatcatgtatctaatttgctatattattacttgataatatattatcctataacttaatcac

SEQ ID NO: 133 - DNA, 3355 bp, Glycine max
  misc_feature (1)..(3355): Glyma.08g109400.1
aggaaattttaggaacattttttgttttcttgagaaaataaactttgttgttatttcattttaaatacaaacctaattatttaacaagagaatctatgtttgattttccaccgtatgtagttacacataggcttaattgcactttttatttttaattttttaatttttagtgaattttatccctaattttttaatttgacacattttattttcaatttttaagaaacttgtgaattttatcctctattatttatctatttataagcacaaaagttggggtaaaatttgtcaaaaaaaattaaaattaaggataaattttgtcaaaaaaatttaaagttggaataaaatttggcaaaaactaataagttagggataaaaaaaatataattatgtaactagtaaagtgatgaaggataaaatttgtaggattattaaaagttgagataaaatgtccaaaatttaaagattaagataaaattcgtcaaaaattaaaaaattagaataaaaaatataattaaatctaatgtttagtttatctataagaaaaatttcaaacctgaccccatcttattgcaatgcataatggagtgggtcagtccttccataggatcaccctggaggccacccccctttttttttccctctatgaccttcaccattgacttttcctaatcatcaattcatcactttcgtggcttctcctaatgaaaacgtgttgattaaaaaataaacaaaaaaccaaaaatattgggttgttaaaataagagagtagtcatcagtctacgtagccatgcggggcaccacatagttgaaacaaagcgcagccacgagtcagaggaagcatgcatagcatctacgtaccttagcctacctaccaatatcaactatctatatatatccacctttccaaatcactttccaacatccacccccatcatcatatcataccctttctatcctacttgctacttcccacttccattcttttcttaaccagctaggatggtgagtgttgaagagattcgtaaggcgcaacgtgcagaaggccctgccactgtcatggctattggcaccgccactcctcccaactgcgtggatcagagtacctatcctgactattatttccgcatcaccaacagcgagcacatgaccgagctcaaagaaaaattcaagcgcatgtgtgataagtcgatgattaagaagcgatacatgtacttaaacgaagagatcctgaaagagaatccgagtgtttgtgcttacatggcaccttcgttggatgcaaggcaagacatggtggttgtggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgcccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacatttcgcggcccaactgacacccatcttgatagccttgtgggtcaagccttgtttggagatggtgcagccgctgtcattgttggatcagaccccttaccagttgaaaagcctttgtttcagcttgtctggactgcccagacaatccttccagacagtgaaggggctattgatggacaccttcgcgaagttggtctcactttccatctcctcaaggatgttcctggactcatctccaagaatattgagaaggccttggttgaagccttccaacccttgggaatctccgattacaattctatcttctggattgcacaccctggtggacccgcaattttggaccaagttgaggctaagttaggcctgaagcctgaaaaaatggaagctactagacatgtgctcagcgagtatggtaacatgtcaagtgcatgcgtgctattcatcttggatcaaatgaggaagaaatcaatagaaaatggacttggcacaaccggtgaaggtcttgactggggtgtgctatttggtttcggccctggactcaccgttgagactgttgtgctccgcagtgtcactctctgatcatatatattgagcaagagaacaaatctttcttttttcatatgtattcttggctggccggtttgaaaaaacgtattgtgtttcgattttttttcccctgccctgcaaatgcttctgtttgtatactagtaaataacaacttgttatactattttttcaattaagcttacacacaagttatctatatatgaagttgcaaagtgaatatcttttgtccaattttatcttcattgaaagattctctatgattgatgataaattgaactatagaactgtctcgaaccaggtttacttatgggctaattgtgtaaagagtgttgtgtatgagttatctgggtgtgtgagaaaaattatacagaagaattcaattagtatcaagtaatcgtggtagctaataaaatatacgtcctaccttgattacttaaagaacgaaatcttagttgacacaaaagtatggacagcgttagaaaaaaaatataaaaaatattccatatcacttaccagagtacaggcttcaaggttagaatttggatgatgaatggtttaagaaaagattataagcttccagtttttcagaagaatggggaaaccaacctcgacgatattgaagctgtctttaaagattctgaagtatgttgaagataattagacatgatattgatattgattttctgtgagttctggaatattatctcataaaggattttgcatgtgttttcaggagcaccatgtgacggagaagaacgaacagcagtcaacagcaatgaatgcatttgagttaatttctatgtccaaagggctgaaccttgaaaacttgtttgatacagagcaggtatcaagctgatatcattgaattggggaggaaaataacaaatgacagggacttgtttcatttagtgaactaaatgaaaaagtcaatttgatgaaaaaggtaaacaagttttattaagtggagttgtttctccttaccccctctaccaaacacaccattaaataaagtttcttcatctaatatcttttgtccaacttcatcttcgtagaaagattctttgtgattgaatataaatttaactatgtaaaccaggtttatttatggattaattgtgtaaaagagttgtgccgattaacttagcccactttggcttaaaattttctgtttgttgtgagttatctgagtcagaaaaaa

SEQ ID NO: 134 - DNA, 3801 bp, Glycine max
  misc_feature (1)..(3801): Glyma.07g119900.1
acactttcagaaaagattagtatttacccaagaaaaacaaaagaaaaaaagtgcactgttctccttctttctcccagaagttgagtgaagcagagttcaagtgcagggaggtgcaagccaagcttgcttaatcgcacgcacgcgttgagcgttgaggctcaattgggtttcgagaagaacctgcgagaatgagaaggtagaacttttcgagtcgcagagcgtcgattcgcaaaatggcgaaggttgaaagcagcagcagcattagcatgagcatgagccgcgtggtgctggagccccacgcgcagttcgacctcacggcccactcacgcgccagctccattcgatccctcgcaatcgcccactcgaaacgacaccatacgactcttttctacgttggaactcactccggaactctcttttccctctccgccgaagattccaactacaccgacgacgacgccgttttgcgcaagctctccttcctaagaagcgtttcggtcagcgacaccgccgtcgagtccatttcggtcatcgaagagttcgggaagcttctgctgctctccgatggggctctgttcttggtcgattccgagctctcaaatggcgccacgaaattgagtttccccaagggggtttcgttggtcacgaggagaaggttcaggaacaacggcggtggagaatctgagggtttcggttcaggtttaggttcaggttcgggtttagggttgtttcagaaattgagaatgaactcaatgaaggaggttgatgtgcagagtgagacaggtggtggatttgtttttgcagttgttgttggtaagaggctgattctagcggagcttgttttggggaataggaatgggaaaactgagagggatgatggtggtggtggtactcttgtgattttgaaggagattcagtgtgttgatggggttgttagtgccatggtgtggctcaatgattctatagttgttggtactgtgaatgggtacagcttgatttcctgtgtgactgggcagaatagcgtgatcttctcgttgccagacgtgtcacggccgcccaggttgaagctcttgcacaaggagtggagggtgctgttgttggtggacaatgtgggggttattgttgacccccacgggcagcccgtgggggggagtctggtgttccggcacggcttggacttggtgggggagattgattcctatgtggtggttgtgagtgatgggaagattgagttatatcataagaggcattgtggttgtgttcaggtgttgccctttggcggggaaggggttgggcgatgtgttgttgccagcgaggaagataggggtgggaggcttgttgctgttgcaactgctaccaaggtagtgtgctatcagaaattaccttcagtggaacaaataaaagaccttctgaggaagaagaactataagggagccatatccttggtggaggagcttgagtcagaaggtgaaatgtcaaaagatttgctctcgtttgttcatgctcaagtgggatttctcttgctttttgacttacattttaaagaagcagtggaccacttcttgctttctgagacgatgcaaccttctgaagtattcccatttataatgcgagatccaaatcgctggtccttactggttcctaggaataggtattggggtttgcatcctccaccagcccctcttgaagatgtaatagatgatggcttgatgacaatccaaagagcttctttcctgaggaaagcaggcgtagaaacaatagtagatagtgacctttttctcaatccagcgaatagagctgatttgttggagtcagcaatcaagaatattagcaggtatttggaggcctgtcgagaaaaagacctaacggaatcagtcagggagggagttgatactctactaatgtatctgtatagagctttaaattctgtcgaggacatggagaggctggcttcttctataaactggtgtgttgtggaggaattggaacaaatgctagaagagtctgggcacctacggacacttgccttcctatgtgcaagtaaaggaatgagctcaaaagctgtgcatatttggcgcatcctggcacgaaattattcatccggcctctggaaagacccttctttggagaatattacacagaatagtggggaaaaccttatttctggcagggcaattgctgcagctgaagcttcaaagattcttgaggaatcatctgaccaagaattgattctacaacatctaggatggattgcagatatcagccaggttcttgcagtcaatgttttgacttcagacaaacgagagatccagctttctcctgatgaagttgttacaactattgatccgcagaaggttgaaattttacagaggtatcttcagtggttgattgaagaccaggactgtaatgatacacagctgcatacattgtatgccctctcacttgccaaatcagcaatcaaagcctttgaatccgaaaatatttctgagaatcttgatagtggaaatatagggacaagaagtttggccatgttgaagaactcaatctttaagattcctgtcagggaaagattacagatatttttgcagtcctcagacttgtatgatccagaagaagttcatgacttgattgaaggatcagaattgtggttagaaaaggctattctgtatagaagactggggcaggagactttggtcctccaaattttggctttgaaactggaagacagtgaagctgctgagcaatattgtgctgagataggaagagctgatgcatatatgcagttgcttgaaatgtatttggatccacaagatgataaggatcctatgtttactgctgctgttcgccttctccataaacatggagaatcactagatccattgcaagttttagagaaactgtctccagatatgccgcttcaacttgcttctgatactttactaagaatgttcagggccagagttcatcatcatcgtcaaggacagattgtgcataatttatctcgtgccgtagacattgatgcaagattgtcaagattggaggagaggtcaaggcatgtacagattaatgatgagagtctctgtgactcctgtgatgcacgccttggtacgaagctatttgcaatgtatcctgatgactccgttgtatgttacaagtgttaccgccgtcaaggtgagtcagtgtctgtctcaggtcgcaattttaaggaagacatcctaattaaaccgggttggctcgtgagtcgttgatctcaaaccttagatgttacgtatgtatttcttggttgaatcccagaagttgccattccttataccaaatccaaattcattcaaaattgggaaaaggaaatgcgtcaataatctctcgggctacataattaacttaaaaccatcaagtgtgtgtttgcgtcaacgtccggtttgacacaatggagaagcaactaggctgttgctttggcgtttgtctcgaaatgtgttttttccttcaacgtggtctaaacaatttgccaaacacagctaagtatcagcttctaacccccacaccaagagtaaagttcatatagttattaccccatgatggtaccgtaaatggctgctgagttctccattgtactctccccccgcccctcccccgcaaattgctttgtaaatttgatgatttaaaatgtaaattttgcacataataatgagctcattttccgttgtagttcttatgaaactcgtttgcagcgttcaatatttaggagtaataggtgaagtattttcaaagcaacaactgcagatacaatctacttttactgtg

SEQ ID NO: 135 - DNA, 2353 bp, Glycine max
  misc_feature (1)..(2353): Glyma.20g179900.1
gggttgttgtaaagtggagttggtggaactaagagaagagaagagaaggttacagaaaaacaaacacttatctctgtttctccgtcttacggcaattgaaggaagcactatctctgcaacttccgtcacattcacatggcagcaacatcagggaagattgtccaatttttttttgtgtcaaactgccaccaacagaatacacagggtcgaagggactattgttttgccccttctcggctacggaagttggcatggactgcctcttccatgcaattccgcactttattcaaaccccagaatcattttagtgtccagagaaattttcactgcaatgcttctgcatctgctactgctgtgccatatctagacaagacagattttctaaagcttcaaaatggcagtgacattcgtggtgtggctgttgatggtgttgagggagagccagttaacctcactgaacctgttgccgaagcaataggagctgcttttgctgcatggttagtggagaaaaagaaagctgatgcttctcagcatttgagagtttctattggtcatgattcccgaatatcagccaaattattacagaatgcaatatctcgaggtcttgctggtggtggcctagaagttgtccactacggattagcatcaacaccagccatgttcaatagcacactcacaaagaatgaagcatttttgtgtcctgctgatggatctattatgataacagcaagtcatcttcctttcaacaggaatggattcaaatttttcacaaatgctggtgggcttgggaaggctgacatcaaagatatcttagagcgagctgcggacatatacaatcgatttacagaagaaagtttgacaaattcagagagaaaagcttcactatctattaagaaagttgattacatgattgtttatacatctgatctagtaaaagcagttcgcaaagcagctggaaacatagagaaaccattggggggtttccatatagttgttgatgcaggcaatggagcaggaggcttttttgctgcaaaggttctggaacctctgggggcaataacttctggtagtcaatttttggagcctgatggcttgtttccaaatcatatcccaaatcctgaggacaagacagcaatgaaagctataacccaagcagtccttgataacaaagttgatcttggaattatttttgatactgatgtggacagatctgctgctgtggatttcactggccgtgaattcaacaggaatcgtttaattgccttaatggcagctattgttcttgaggaacatcctggaacaactattgtcacagacagtgtgacttctgatgggcttaccacgtttattgagaagaaacttggtggcagacaccatcggttcaaaagaggctacaaaaatgtgattgatgaagctattcgtttgaattctattggtgaggagtcacatttggcaattgaaactagtggacatggagctctcaaggaaaatcattggcttgatgatggcgcatacctaatggtcaagatcttaaataaacttgcttctgcaagagcttctggaaagggtggtggaagtaaggttttgactgatctaatagacggacttcaggaaccagattttgctgtagaactgagattaaagataaaccaaaaccatccagatcttaaaggaggagctttcagatcttttcgggaatatggagaagctgtgctgaaacatttggagaactcaattggctctgatccaagtctgcacaaggctcctgtgaactatgaaggggtccgagtttctggctatggtggatggtttcttcttagattatcactccatgatcctgtacttccccttaacattgaggcacctagtaatgatgatgctgtgaagcttggacttgctgtgcttgcagctgtgaaggactttgcaggtttagacacatcagccttgaacaagtttgtaggagcatcataattggatgcttcatacaataattgagtctggtgctggagagtgctttcacttctatttatgcattatacaaagaggttctctatacgtgcatcagcggcaagaggatgaattaaagacagtgaactagagttacctctaaatggagtatggtctgttgtggactagaaatatcagaaatctctactatagaattttcatgagacgtcacatttttgagatcactgtgattaaatgtatggtgtaatttttgttgtgctttgccattgaatactattgacccttttcttatatgcatttggactctcgtaggctcactgataagatgtgccctttccatttgcggagagaatagtcttggttatcaacttctcttgacaagaaa

SEQ ID NO: 136 - DNA, 1437 bp, Glycine max
  misc_feature (1)..(1437): Glyma.14g200600.1
aaaattataaactcgttttcgtcattgctcgcaacagggactgagaattcaacttcgcttggtcttgtcgaattctgttctccgcaatctcgcaatcttcgccgttggattcggtggttttgtcgcaatctcgcaatcctctttcattcgaagactctctcccctttgcctatgttgatagtaagattgtagttcatttaaagaggctaggcaggaaggatcccaccactgagagtccaaaaattttccaaacatgaccaataaccatgtgttccttgcttattgtccttcaaagtgtagtggtgggtggctgagagagaacgagtaaacaaagcaaagatggaatcggcaacctcagagtcaccgtatccaggatcagggaattgggagatcccaattgatctgttcggttccaaaaaacatgctggagtctcacgtggtgttctagcattcacagatgagtctggtaacatagtcttcagggtgaaccgccacccacccaatcctaactcatcgccccttcccaaggacaagaaactcttgcttgatgcctcaggcaataccctcttctccatctaccgttatcataatgggtcttggaaatgctataagggaaatagtgatgagaacaaggagctggtgtttagtgtgcagaggaccctcaaaactcttactcgagttgagttagaggtacttttcgcagctgagaggtccaatgacgaaggttgtgatttgaaagtgaagggttcccctttccagagatcatgttgcatatataaagatgctgatttggtggcacagagtagcctgatgtacaagctccaccaaatgtttgtcagtaggagtaaatttcgcctaacaatctttcctgggactattgaccatgctcttattgtggctttgtttgtgatatttttgagtggaagaaaatagtatcattaacacacgacatgcaaccgcaagagataaaagattttgatctataatctttctctgtcttgctcatacacagatttattttgctcgaaacattctttcactaactaatagggggagtaaatgaggcattgctccttacatgcaacgtattatttcagctggtacgagatactagtccctaaaacatgtgcattatccttaatggataaagctcttatttcagcaatatttattcattctcaccactcatatggcatatagccagtatgtattcaacttctccagcaagatgctttgatgtaatcaaacatagatatagattttgaggtagcactcaagatgtataataaagatccagaggtagagaactaaaggctcgtcaaacagaatatctgtgctgaaattagcttcagcggttaaattgtttatttatttagcgaaattggacacatgttcttatcgttagtctgtgctagtttggtgtagtttttgacccct

SEQ ID NO: 137 - DNA, 3349 bp, Glycine max
  misc_feature (1)..(3349): Glyma.15g023800.1
atcttcaaattaaagtcacttacaatatatatataaaaacattgcaaagttgcagccccggttatttttattatttttattccgatcatcattttgcatagagaaaaagcaaggaagaataataagggagagagagtgagaggaagaagggaaaaccaaagacacttcctagttacttccctctgcagccataatagaataaccagcaccaccaaaggtgaatcatggttatttgcttgaagctcataataatgtggaatgtggcactgcttctggttttttctctaattggttctgctaaggcctcagtgtcctatgactcaaaggctatcaccattaatggccagagaaggatcctcatttctggatccattcattacccaaggagcacccctgagatgtggccagatcttattcaaaaggccaaggatggaggtttggatgtgattcagacttatgttttctggaatggacacgaaccttcacctggcaagtattattttgaggggaactatgatctggtgaagttcataaagctggtgcagcaagcaggcctttatgttcatctcaggattggcccttatgtctgtgctgagtggaactttggtggtttccctgtttggctaaagtacattccaggaatcagtttcagaacagacaatgaaccatttaagcatcaaatgcaaaaatttaccacgaagattgttgatttgatgaaagcggagaggttatatgaatctcagggtggtccaataattatgtcccagattgaaaatgaatatggacctatggagtatgaaattggtgctgctggtaaagcttacactaagtgggcagcagaaatggctatgggacttggtactggggttccatgggtcatgtgcaagcaagatgacactcctgatcctcttattaacacttgcaatggcttctattgtgattatttctctccaaataaggcttacaagccaaagatgtggacagaagcttggactggctggtttactgagtttggaggtcctgttcctcatcgaccggctgaagacttggcattttcagttgcaaggtttatacagaaagggggatcatttataaattattacatgtatcatggaggaacaaatttcggtcgaactgctggtggtccctttattgctacaagctatgattatgatgcaccacttgatgaatatggattgctcaggcaaccaaagtggggtcatctgaaggatttacacagagcaataaaactctgtgaaccagctttagtatctggagatcctactgtaacaaagattggaaactatcaagaggctcatgtctttaaatcaaagtcgggagcctgtgctgcattccttgcaaactacaaccccaaatcttatgcaacagtggcatttggaaacatgcattacaacttgcctccttggtctataagcattcttcctgactgcaagaacactgtttataacactgcaagggttggttctcagagtgcccagatgaagatgactcgtgttcctattcatggcggattctcttggctatcattcaatgaagaaacgaccactactgatgatagttccttcaccatgactggcctgttggagcagttaaatactacaagagatttatctgactacttgtggtactccacagatgttgtgcttgatcccaatgaaggatttctgagaaacggaaaggatcctgttcttactgtgttttctgctgggcatgctttgcatgtttttataaatggtcagctatcaggaactgcatatggaagcttagaattccctaaactgacatttaacgagggagtgaagcttagagccggtgttaacaagatctctctactgagtgttgcagttggactcccgaatgttggtcctcattttgaaacatggaatgctggtgttcttggtccaatttcattaagtggtctcaacgaagggagaagggacttgtcttggcagaaatggtcttataaggttggtcttaaaggtgaaatcttgagtcttcactctcttagtggaagttcctcagtggagtggattcagggatctttagtttctcaaaggcagccattgacttggtacaaaacaacatttgacgcgccagctgggactgcaccattggctttagacatggacagcatgggcaaaggtcaagtgtggttaaatggacagaatcttggccgctactggcctgcttataaagcatccggtacctgtgattactgtgactatgctggaacttataacgagaataaatgcagaagtaactgtggcgaggcttcccaaagatggtatcatgttcctcaatcatggcttaagccaacaggaaatttattggttgtgtttgaagagctaggtggagaccccaatggaatctttttggttagaagggatatagatagtgtatgtgctgatatttatgagtggcagccaaatcttataagctatcagatgcaaacttctggcaaagcacctgttagaccaaaagttcatttatcatgtagcccgggacagaaaatctcatcaatcaaatttgctagctttggtactccagcaggttcttgtggaaacttccatgaaggaagctgtcatgctcacaagtcttatgatgcctttgaaaggaattgtgttggacagaactggtgcacagtaacagtgtcacctgaaaattttggaggagatccatgtccaaatgtcttgaagaaactctcagtggaagctatttgttcctgatcattttaacctcagaaaataaatagattaaactctccagattgatttttcccaccactattcatttcaatacagttcttttgggtcaaccaaagtctacacttctgaatctgatcaacacgagcattattattttggctttaccaaggtgaagttgcagaaaacacaacacaccatatggttgaaagcctgtaaagattgctgagatgattgtggatatgtgtatatacttgtgttctgcatgttatacagaggtgaaaggtgatgatttgcttggtgcactatgagacgatactgaattgagtccatgtgctagtgttttagacttaggtgtggaagcctcttgcttcctgtaatattagttttcccttgtaagctgcattcatagtgatttagtttctttcttcctgtaagaaacttctcaagatgataaagatcagattcagtcattttggtttcgttatttcatgcattgtggcttttggtttctagatgttcttgttttagagttctttcgggtttcattagatcatattgattctaccaaggcagataatgctaccatatttttggattgatgataaatattgaaatgaagtgga

SEQ ID NO: 138 - DNA, 2593 bp, Glycine max
  misc_feature (1)..(2593): Glyma.02g274600.1
ttatatcaatgttttaatcccaccaataatgaatgacacccccacttcacgttcaccaagagcaccaccataagcaataataaaagcaagataatgcaacccactctgtcccttttctcactcactctttcttcccaccttcctctccttctttctttctgcttaaggtctacacaagttctctgcttcttctccccctattgacctttggtcatcacaagcgaaaacccacttctggatcttctggtgtaaaggccattagaagctttagaaattttctaattgagttggtgtatagtgttgaagggggtgaaatctggagcccagtttgttagttgttactcacttcatctgtaagctcataggttgaaccctctttttttggagacttacctgggaaaagatgatgatgtttgaagatatggggttttgtggcgatttggatatgttatgtgtttctcttggagagggggatattgctgtgagacaaactgaaccggatcctgtagttgaggatgactacagtgatgaagaaattgatgtggatgaacttgagaagaggatgtggagggacaaaatgcgtcacaagcgattgaaagaacaaaccaagtccaaggaagggactgatgcaacaaagcaaaggcaatcccaagagcaggcaaggaggaaaaagatgtcaagagctcaagatggaatactgaagtacatgctgaaaatgatggaggtttgcaaggcacaagggtttgtttatgggataattcctgagaaggggaagccagtgactggagcatcagacaatcttcgtgaatggtggaaggacaaggtcaggttcgatcgaaatggtcctgctgccatagtgaagtatcaagctgataatgcaatccctggaaagaatgatggatgcaattccattggtccaactccacacaccttgcaagagttacaggatacaaccttgggttctctcttgtcagcacttatgcagcactgtgatccccctcagaggagattcccattagagaagggtgttcctccaccatggtggccaactgggaatgaagaatggtggcctcaaattggtctacctaaagatcaaagccctccaccttacaagaaaccacatgacctaaagaaggcatggaaggttggtgttctcactgcggtcatcaagcatatgtcccctgatattgccaaaattcgcaagcttgtgaggcagtctaagtgtcttcaagacaaaatgactgcaaaggaaagtgcaacctggcttgccatcatcaaccaagaggaagccttggctagagagctttaccctgactattgccctccattttcctctgctggaggtaatggatccttggtgatcaatgattgcagcgagtatgatgttgatggggccgaagaagagctgaactttgatgtggaggaccggaagcctgaccatcttcttccatcaaacctcgggatggagagaatgaggggaaggatgccaattcagcaaccttctcatccaatgaagggagatgttgtcacaaacctagatttcatccggaagaggaagatttctagtgacttcaacatgatgatggatcagaaaatatacacatgtgagcacccccaatgcccttatagcgaagttcgccttggtttccatgataggtctgctagggacaatcatcaattgaattgtgcatacagaaacagttctgcagattatggtggtggtcccaatttccatgctactgaggataagccagtcatattcccccagtcctttgttcaacccaacactacaacacagtctgcaagtttggttgcaccttcatttgatctaactggtcttggagttccggaggatggacagaaaatgattagtgaccttatgacaatctatgatacgaatgttgtaggaaacaagaacttaagttcctccaactgtgtagctgtagaaaatcataacctttctcaggccagcttacaacaacaagaaagttatttccctggtcaaggaatggtgttggaagggaacttctttgcacgagaggaaggtcaatttgaccggttcaaggccaccatgaacatgaacactcataccccttttgataccaaccatagcaacaataataatatccatttgatgtttaattccccttgtgatttgtcatcctttgatttcaaggaggatatacaaggaggagtaggaatggatcctcttcacaaacagcaagaggtttcaatttggtaccagtgaaaatgacaagaggggaaactcgtgtatcaagggcttttattgtgtcattaaaaggggacatgtgaaagtcccttgactcaaaaggcagttaatgcatttttcttcccatgtaatcgtttaggtctttagatatttttatgctttggcaggtctggtctggtggtactatattatgggttaataaatcatgggtgttcccataatgtaacccttttaatgtgtgtctttatgtgttagccctatgttgttacttactatcatatgtacgactgtgacataaataaaagatttttattctcttataaaatcatatttccattgctgcattcatagttaaggaatctg

SEQ ID NO: 139 - DNA, 4083 bp, Glycine max
  misc_feature (1)..(4083): Glyma.06g016700.1
aaaaaaaatcactattatttctcacgacctaaagaaagaagaaagaatgatcataagatcattagtgtaatgaaattaggcacatagtttaatttataagtatcattagagtaaaatagaacggtgtgaaaaaaaaaatttcatcgaatatttgttataaaagtgtataacatggagaatatgtataaatcaaacttttaaagagttaagatcaaaattatttataaagattatttttaggatgtattgttaattattaaattttgattgttttgtttgagtgtctgaacagtgcgattagatgtagatgtaaatggaaatggaatgaaatttgtatgcctccctagaggcacagcctgtgctgcggtcgttcgttgcagtcggagaagacgccacatctcaatcatttcaacctcgccctcgccgggaatatatatataaaacatattctattcactttttttttcgctttcctttaattcttccaaatctgcgaattcagacacacaataatcgaattccctctttctccgcaattcatcctctcttccacgaaatcccttactaaccgactcaatctacttcaatggatcagttcgaatcgtttttcaggagagcagatttggacggagatggcagaatcagtggagccgaagctgtctctttctttcagggatccaatttgcccaaacaagtcctcgctcaggtgtgggcgtatgctgatcaggccaaaacgggattccttggccgcgcagagttttttaatgctctgaggttagtcactgtggctcagagtaagcgagatttaacgcctgatattgtgaaggcagcgttgtatggtcctgctgctgctaaaatccctgcgccacagattaatcttgctgccgtgcctcaacaacgtccaaattcgatgcctggtgctgggtctgtcgggcagatgggtgttaccgcacccaatttggctcaaagttttccctatagaggacaagggttggcaggtcctggtgcaaacccgcaatattatccttcgcagcagaatcctggcatgagacctcctcaatccatgcctgctggtggcggtctgcatccacaacagggtgttgcaggtccagatatttctagaggagttaacatgggtggtcacagtttctcaaatcctggcgtctcaaatgattggaataatgtaaggcccggtatggttgctaccagacctgcaggaatgatcccgtcagctgccttaccgtcgtccacatctccagtttcaccaatgccccagtcatctccaatctcaccaatgccccagtcaacaactgttaacactaaagcattaggtgtttctggaaatgggttctcctccaattcagttttgggcaatgattttttctctgatgcctcatcgacacagaaacaagaacctgctggacagagttattctgtcagcaatgtctcatcagccattgttcctgtttccactgcttcccaacctgcaagtaaacaaaattcacttgactcattgcagggtgcatattcttcaatgctgcctgcaaatagtcagtttcagcggccacagtctgcaccaatcacaacccagcaaatttcaccaccagcttcttcttcaccacatacaccatctgggatgacagctgggcttggaaatgcaaattctgacaattcacagctttcttggccaaaaatgaaacctactgatgtgcagaagtatacaaaggtgtttatggaagttgacactgacagggatgggaaaatcactggggagcaggcacgcagtctatttttaagctggagattacccatagatgtcttaaagaaggtgtgggacttgtctgatcaggacaatgatagcatgctttcattgaaggagttttgctttgctctttatttgatggaacgttacagggaaggtcggcctcttccacagtctcttccaagcaatgttatgtttgacgagacactgatgtcaatgacaggccaaccaaaaagtgcttatggaaatgcagcctggggtattggccaaggttttcggcagcaacaaggtattccaggtgctcggccagtggcaccaacagctggtttgaggccatcagtgcatggaagttttgcccgggctgatggcactcaacagcccaatcagcaaaagtcaggaacacctgtgttggaggattcctttttgaatggtgagcagaatatattgaattcaaagcctcaagaggcagcaactgcagagaaaaagtttgaagaaactcagaatgtgattttggattcaaaagagaagattgagttataccgcaacaaaatgcaggaactggttctatatagaagcagatgtgataatcgactaaatgagattacagaaagggcgtctgcggataagcgtgaggcagaatcattgggcaagaaatatgaagagaaatacaaacaagtagcagaaatagtatcaaaattgactgttgaagaagctaaatttcgtgatatacaggataggaaggtggagttgcagcaagcaattgtcaaaatggtacaaggaggcagtgcagatggtatccttcaggtccgtgctgaacgcatacagtcggatcttgaggagttatttaaggctctggctgaacggtgcaagaaacatgggatagatgtgaagtcaattacaatggttcagcttcctgctggttggcaacctggaattccagagggagcagctctttgggatgaagagtgggataaatttgaggatgaaggatttgctaatgatctcacttttgcatcttcaaaaccgaatcctgcatttattgatggagaacaaaatttatctgatgataattctgttcatggttcacctgtgaatgcaaatgggaagcaagaaaattctgctaatggtgattatacagttgaggatgaatcctatgcacacagtgaagatgacttggcaagaagcccccatagtctagctgggaggagtacgttgggtagtccttctcgagacttttcaaatgctcattttggaaaaagtttcgaagcagatgcagaaacacacagaagttttgatgaatcaacctggggtgcatttgacaacaacgaagatgtggactcagtgtggggttttaacactaagaccaaggactctgacttcgagcagggagatttctttaaatccgacgattttggtataaacccagttagaacaggatctacacatacagatggcacgttccagtcaaaaagcccatttgcttttgatgattcagtgcctgcaactccagtttccaaatttgcttttgatgattcagtgcctgcaactccagtttccaagttcggaaactctccaaggtacagtgaggcaggggatcacttctttgacatgtcaaggtttgattccttcaggcacgaaagtggatattctccacaaccagagaggctcacgagatttgattccataagtagtagcagcaaggattttggttacaataatgataaattcacaaggtttgattccataagtagcagcaaggattttggctacaataatgataaattcacaaggtttgactccataagtagcagcaaggattttggctacaatcctgagacgctcacaaggtttgattccatgagtagcagcactgatttgggcttcggtcgacagggacatgcaaggtttgactcaattagtagcaccaaggacttcggtcacagtggtccgttctcttttgatgactctgatccattcggctcctctggcccttttaaggtctcttcagaaaatcattctccgaagaaaggttcagataactggagtgcattctagcctgcaatccaactcttcccgattttctttgttgtttctatttccttgattgttcatgacagcctatttttttgtgtatagctagaagaaaagctggacggtaatatatggtgtggccaatgtatcagtttgaagagagctttttctatttttttggggtaatgttcggatgttgtgtgaaagatagatagataaaattaaatgtcttgatgcgtatttactactaagtttaatggcaagtgcatgcaaagttttttttttttttt

SEQ ID NO: 140 - DNA, 2143 bp, Glycine max
  misc_feature (1)..(2143): Glyma.06g238500.1
aagtactcacgcagtttccttttctgtcttgcacccgtgctaaaattttcttctgctttacactgttccttgatgtgaaatatctgtttcttttgttttcctctcaattccaccacttccttcttgggttctgaaaatcatacactcctctgctttgaaacagagacccatttggctaaaaaagtctgcaaaggttaggactttcgtgggtggctgaggtttcaattgaatagtcactgttgagtgatggagttgagctacctgcaatgttaatggtaatgggatctttactttttgttagtattgcagaagcaaaaaatggagccattattttcttcagcagcagcaatatgtgtggtgactgtgttggtagctgtgattcccatatgggcactgaagatgctgaactcgctgtggcttaggccaaagaggtttgaaaggcttcttagagcgcaaggttttcatggtgacccatactcactttctcatcacaactccaaccaaacccttttgcaacaacaccagctcaattcccaaccttttcctctatccgatgatgttgctcctcgtgtatcctccttgttacatcacactatcgacaaatatggcaagaaatccttcttttgggaaggtagaacaccaaaggtgatcattacggacccaaatcaactcaaagaagtcttcaacaacattcatgacttccagaagccaaagtttagtgacaatgtcaagttcttgttcgctggcctgttaaattatgagggtgacaagtgggctaaacatcgaagaattatgaacccagcatttcactcagaaaaattgaaaaatatgctaccagcattttctcaaagctgccatgatatgattagcatgtggaagggaatgttgtcatcagatggaaaatgtgagattgacatttggcctttccttcagaatttaactcgtgatgtaatttctcaaacagcatttggaagcagctatgcagaaggagaaaaattttttcgaaatctgagaatgcaggggtatcttttaatggcaggaaagtacaagaacataccaatattgcggcatctacgtacaactaccaccaagaggatggaagcaattgaaagagagatacgagattcaattgagggtatcataaaaaaacgagagaaagccatggagaatggtgaaacctctaatgaagatttattaagcatacttttggaatcaaatcacaaggaaatccagggacatggaaacagtagggctgttggaatgaccaagcaagaagtaattgaggaatgcaagctattttacctggcagggcaagagaccacttcatctctgctggtttggacaatggtcttattggctaggtatccagaatggcaagcacgagcaagggacgaagtttttcaagtttttggaaaccaaaatccaaacattgatgggttaagtaagcttaaaattgtgaccatgattttatacgaggttctcaggctatatcctccaacaactttctttagtcgcgcacctcaaaaggatgtgaaacttggaaatctatcactacctgcaggaatacgcattaccatgccaatattatttattcatcatgatggtgatatctggggtgatgatgcaaaggagttcaaacctgaaaggttttctgaaggaattgctaaggcaacaaaaggccaaatttcgttttatccatttggatggggtcctagaatatgcattggccaaaactttgccttaatggaagcaaagatagtgttatcattgcttctgcaacatttctcatttgagctttctccggtctatgaacatgctccaacggttgtgcttagtttgcagccaaaacgtggggcacacatcgttttgcataaactatgatatgattcatatattggaattagtcatcggcttgcgggataaggctacgcatatctcacttggtttagtgtgttatacattatatttcctttatatagtatcaatcatgtacttgtgtgtggaatgaaaactatctttaattaaggatcttgcaagttgtaatgcaggtgtatttgaatatgtagtatatggtatattgaaaactatcttttgagtttggtcactggttacggaggaataaaagggaaggatttctctcctc

SEQ ID NO: 141 - DNA, 1700 bp, Glycine max
  misc_feature (1)..(1700): Glyma.15g071300.1
ctagatttataatctgattaataatatatatttctcgtggccacttaccagtgtactttatccacgcccatataaaagttttaacatttttaatcagttctgacgtgcatattattattataatgattaatagcacttagtagttattttttcatctttatctacttttcttgttcggatagaattcccacgttgacacacacggtttctctcttcgtattgcaactatatatattaaacatgaacgactcattcttcctatcatatcattgtccgttttcaaaggctatcactaaatctcattcttcatctgcagctatttggattgctgattattgttaactgatattggtgcttttctttgagaaagtgtgtacactttttggataagagaaaacaagagaggtgacattggaagctaactcagagagaggcaaagatgttgggaattttcaagcagaagttggttaatgcacccaaggagctgaacagtccagcttctttgaattcatgcattaagcctaagctaagtcatgaaatcctgaaggatttcatgtcctgcaattcctccaatgctttctcaatgtgctttgggaatgatgctttgctagcctattccacttcatacaagccctccattaatcataggttattctctggattggataacatatactgtgttttcctgggtggcctgcacaaccttagcatgctcaacaagcagtatggactatcaaagggaacaaatgaggccatgtttatcattgaagcatatcgtacacttcgcgacaggggtccataccctgctgatcaagtcctcaaagaacttgaaggcagttttgcatttgtgatctatgacaacaaggatggaacagtttttgttgcatctggttctaatggccatattgagctctactggggtattgcaggtgatggttctgttataatttctgaaaatctggagcttataaaagcaagttgtgctaaatcatttgcaccatttccagctgggtgtatgtttcatagtgaacacggtctcatgaactttgagcatccaacacagaagatgaaagcaatgcctcggattgacagcgagggggttatgtgcggggccaacttcaatgttgactctcagtcaaagatccaggtgatgccacgtgttggaagtgaagctaattgggcaacttggggctaacaagcttagctgattcttagtccagcatttttctttctaagtggttaaaagtgtaacctaatatgatgagtgtgtgactctttgcttttagcccgtttggatatctgcttttctcgtttggttccattgttgtgtacatattcatacttcaatattgaacatgactatgtctggaagaagctgcgtcttgatgtctctgggaacgagcgtgacgacaacagtgtcatcatcatcatcgtcttgcaagaaatcagtgtgatcggggcgaatcaggttataatcttgggcgttgatgatgacatcaaactttggatgtgcgtttccctcaaagtcgatcagaagaacaaccaccgcgctcacagctgaatccaacaccagagggaacatggtggtcgtggctagagcaggagaggcaaaagcaaaagctttcttgttcagcagcaccacaaatccctcctaggccaactagaaagttcctccgatgtgggacttcttctccttcggg

SEQ ID NO: 142 - DNA, 891 bp, Glycine max
  misc_feature (1)..(891): Glyma.06g130800.1
tttaggtttttcaattaatttattcatgaagatctttaaatgctttttaatttataggttttaatcttgataattttttttataggttttaatttattcataataccgaaagcaagttccagatagcgcgaacgcgaacactcttagccatggctatccgaatcaactccttcactctctcttccgctttacctaagatggagctaagaggtggaaattcgcgcctctgggttagctcacagatgatgccgcaaatgcgaaaggaggctcgtggacgacgagtttggaggcgaagaaaattgataaaaaaggatgaatatatgcaccccaaaatggagcgcattcctttcatggaggagcaggtaaggattgtaagggaacagggaaagctcttgacgatggacatagagaggttaatgttatcagaagataatcggtttgattttgtgaatgagatagcagctgaggccaattcttatgttgagaacaacagggatgagtatggaggtgagaaaaaggccattcttcatgttttgagcaaccgaatgaatgatactggaatttacaggccagaagcatattatgagcctgatcccttcaagcccggacctcattatttgagagaagaatttacataagcccagaaaaaaaatgttatgctggcatcttaaactagggacaagaatttacatctttgcttcacttagcttaattgatttctgtcttaattagctgttgtttgtatgtatgcaaatcaaagccatcttctaaccggaaataaaatacaattaaaaggtagtattttctactcattctaaggatgttgaaaatggattataactagcattgcatttgttttcacagtttaaaagtgtaatctcttgcaatccc

SEQ ID NO: 143 - DNA, 2736 bp, Glycine max
  misc_feature (1)..(2736): Glyma.09g202900.1
agtggttgaggtgtgtgatccgtaacagtgagaagaagaaagggtgagatgtcaaagcaatggcaatggagttccgcttggacgttgcttctctttctcatcttcttcctctcctcaacaacaacaagcaccactgactacgcttgcaaattctcccagtcccaccccttctgcgacacttccctccccactctcacacgtgcgcgctccctcgtgtccctcctcactctccctgagaagatcctcctcctctccaacaacgcctcctccatcccccgcctcggcatccccgcctaccagtggtggtccgagtccctccacggcctcgccctcaacggccccggcgtctccttcgccggcgccgtcccctccgccaccagcttcccccaggtcatcctctccgccgcctccttcaaccgctccctctggctccgcaccgccgccgccatcgcccgcgaggcccgcgccatgtttaacgtgggccaggccgggctcaccttctgggcccccaacatcaacctcttcagggaccctaggtggggccgcggccaggagacccccggcgaggaccccatgctcgcttctgcttatgctgttgagtatgttagaggccttcagggactcagcggaatccaagatgctgtcgttgttgatgatgatgatacgcttatggtgtctgcgtgttgcaaacatttcactgcttatgatttggacatgtggggacagttctccaggtataacttcaatgctgtggtatcacaacaggatttggaagacacttatcagcccccatttcgtagttgtattcagcaagggaaagcaagctgcttgatgtgttcctacaatgaggtgaatggtgttcctgcttgtgctagcgaggaactcctgggactggctagagacaagtgggggtttaaagggtacatcacctcagattgtgatgctgtggccacggtttatgagtatcagaaatacgcaaaatcccaggaggatgctgttgctgacgttctcaaagcaggtatggatattaattgcgggacgtttatgcttcgacatactgaatctgctattgagcaaggaaaggttaaagaggaagatttagatcgagcacttcttaaccttttctctgttcaactgcgccttggactgtttgatggagaccctataagaggtcggtttggcaaattgggaccaaaggatgtttgcacccaagaacacaaaacactggcacttgatgctgcaaggcaggggattgtactgctgaagaatgacaagaagttccttcccttggatagggatattggtgcctccttagctgtcattggtccattggcaactacaaccaaattaggtggtggctactcaggaattccttgctcctcatcaagcttatatgaaggacttggagagtttgcagagaggatatcatacgcttttggttgctatgatgtaccatgtgattctgatgacggttttgctgaggccattgacactgcaaagcaagctgattttgttgttatagttgctgggcttgatgcaacgcaagagacagaggatcatgaccgagttagtcttctcttgcctggtaaacaaatgaaccttgtatcatctgtagctgatgctagtaaaaatccagttattcttgttcttattggtggaggacctcttgatgtctcttttgctgaaaaaaatccacaaatcgcaagtattatttggttgggataccctggtgaagctggtggaaaagctctagctgaaattatctttggagagtttaatccagccggaagactgccaatgacttggtaccctgaggcatttactaatgttcccatgaatgagatgagcatgcgagctgatccttcacgtggttatccaggaaggacctaccggttttatactggaggtagagtatatggatttgggcatggtttaagtttcagtgatttttcatacaatttcttatcagctccaagtaaaattagtttgtctagaaccatcaaagatggttctagaaagagattattatatcaggtagagaatgaggtttatggagttgattatgttccagttaatcagttgcaaaattgcaacaaattgagcttctcagtgcatatttctgtgatgaaccttggtggtttggatggaagccatgttgtaatgttgttctctaaagggccaaaagttgtagatggttctccagaaacccaattggttgggttcagccgtctgcatactatttctagcaaaccaactgaaacaagcattttggtgcatccttgtgaacacttgagctttgcagacaagcaaggaaaaaggattttgcccttgggcccccacactttgagtgtaggggacttagagcacgttgtttcaattgaaatttattgattgcttgtaaaatgtcaaatgtgtaatttatcgaagggttggcaatttattaaaaaatttaaatgaggatgatatcaaatgatgtatatgtttgtgactgtcacagcgttattgagaaccaaagtctttttttagtcatgaatttgtctattacagttttcttttttagtcatgagttgggcattggagctctagctcgcaggctgccagtataactcacaacccacacgggctacgagcatcaatattaacaacccatttaagaagtgtgctttttagcctgacacgtttaacctgtaggttaaatgttgcttgcgattttttaatgagttaactttttttttt

SEQ ID NO: 144 - DNA, 1581 bp, Glycine max
  misc_feature (1)..(1581): Glyma.07g268700.1
aaacattggaggttaataactgaattttaatataattaggagaaaaagaaattaaaaaaagagggtggaatttgtaggtgaagaacttggagataggcccgcctttgttgaatcttcatttatggtgtttccttctttctggtacttgttgttgttcttattatatatttaaacctcttcctcctcttcttccttttgcttcaaggtgtggtgttttgtgtttcacatttaaagcaacactgaaaagaaaggaaagtgaagttgagagtttgtttaggaagaacaagaaatgggggttggttcccaggatgccatcaagcagttccaggcattcattgaccaagttgaggagcctttgcgaacaacgtttcagaatgttcatcaagggtttgtcaccgaaactttaatgcggtttctaaaagcaagggactgggatccttgcaaggcacataaaatgttggttgactgtttaaattggagggtgcaaaatgagattgacaatatattatctaaaccaattgttcctgctgatttatacagagcggtgcgtgattcacaactcataggattatcaggttactcaagagagggtctgcctgtctttgcaattggtgttgggcttagcacatttgacaaagcatctgttcattattatgtgcagtcacacattcaaattaatgaatatcgtgagcgtataatcttgccttctgcatcaaagaagcaggggcgacctattaccacttgtataaaggttttagacatgactggtctgaagttatcagccctgaatcagattaagttgctaactattatatcatccattgatgatctgaactaccctgagaagacaaatacttattacattgtaaatgctccatacatattttctgcttgttggaagcaggttgtgaagccacttttacaagagaggacaagaagaaaaatacaggtgttaccaggttgtggacgagatgagctattgactatcatggattactcgtctctaccacatttctgtcgaagagaaggctctggatcatccagacattctgagagtggtagtgaaaattgctattccttggatcatcccttccatcaagagctctacaatcacatcaagcagcaagccagactccgtgaagctgttgaacccatcaagcagggatcatttcatgtagattttccagtacctccagatgatgaagttgagattgccaagactatagagtcagagttacataagtttgagaacggaaatggtgtctgatactttcttttaggatctactgtggagacctcaaaatcagagatcttttgctagtacaaccaatgtagaaggactccacatcagaattacttttatcaggattcggaagaattagttagcgttgtttatgtatgttaaaagagaaattaagggttagtcaatttaatgcaaatcccagctttacatcgtatcacaatgctagagatcaatgttaaatataatattttatccttgtgtttcctgtctcctgatcttttgcatgtttggtcttgatatttctttaccagttcaaatataagattataatttatgtt

SEQ ID NO: 145 - DNA, 1882 bp, Glycine max
  misc_feature (1)..(1882): Glyma.15g163200.1
ttgtggtccccactcccctatcctttcccacattacagtgaacttacaagtatacaaaaatatattaaattaaagtatatgtttatacaaatacaaaaatattcatataatcatattataacatccccccacccctctctctctctctctcaaaatcattcaggcactcacacacatatacagacacattgcagctccagcttttcccttgcttccctctctcacacagcctgtcatgcctaattattaaccccttgattcttgttttaaaatttgaactggttgctttgttgtttgtgtctaactaaagggttgaacaagaacaacaaagagtttttcatgttgtttctatgagctttctccaaattccccttgaagcgcacactaacttggattgatccttcctttaactttccttttccaaacatgactcaaggagagccatagagaattggccacttgttttgttacaattggttttattagcgagactaacctatgggaaaaaatgctggcatgagggaggaagatgctcaatgaacttcatcacagaaagctgcaattttggtacttcttacaacaggcatgggaactaaaattgaatattccataaatcttctagcatcctcagtagacagcaacaacttcattgtgggtggtgtggatgtctgggagcattatcagaacaaaggagagactaacaaacattgtagtattggagtgaataaattgcaagatccaatggataggatgcttgacagaaacaacatagagtccatcaaaaagacaatgcagatgcatgaggaaatcttcaaataccaggtgagggaactacatagagtatacagtgttcaaaagatccttatggatgacctaagaaaggaaacaaaacaaaagaaattttggacccctatgaatggcatagacataagccattctcatttccttcaacaacaacaacaaactactactacactaatttcatatgggcctgatttccatgtccaaagtttgagagaggacttatgctcaaaggaaaggagtggaagctgttctggagagaccataaaaaggcaaaggggttttgacctagaaaggcctgctgagagagacatttttggtggcggctgtgatgaacatgaggcaggacttagctcctacactgcactagagagatgcaaaataagcagcaacaatgatgatggttatgatgaagacatggaagtggatttgactctaagcataggaggaggaagccaagttaatgataagaagaatagtagtagtaagaaaccttatctgcttccattagggtgctcagactcacccaatgggaaaactagggagctaaattcttctgtctctttccaatcagatagggtgggagatttcagtgaccccaccacccctatgagcagctcaagtgtgacatttgatcaagagagaaaggggccacattggctttctcaaggtttaaagcttaaataggagagttttaacttgtttgattgtattatgatgtatccttcctcctctctcaactctacatggaccacggaatttttatggttcatgtgttcagattcctagactagattttcttttttactttattccaataaatggataacttatactcccatttctgagtgtccctttctgtaaataggtagagaaagtttgatgtgcttcttagttcttaagttactttcttgtcctacatattattttcaaacctaaatgctatttattgtaaaagcagaacctagtactacttggcactacatgtgaatttaagtatacaaggagtggcctttgtcataagactatatcaaatcaaaatggttaaggttcccttttggcccaaattcttgctttgaaa

SEQ ID NO: 146 - DNA, 1207 bp, Glycine max
  misc_feature (1)..(1207): Glyma.15g134800.1
gcaagcccacatccacaatctggttcgttcactcgcagcaccacaatccctaattccacattttcccttcgttcaccatttcacctcaccagttagcgaaaatttcaagtccaacgacactcacttcgtgcaggggtggtgctactagtttgttgaaagagcatcttttttcaacctcttgatttcatgagtcactattttgattgaacaagagatgagatttatgcccctttccagattaattttccgtctccctcgtcattatacacatgggcctttgcaatctcgtgccttacagactgattctgttcttaaagatcctcaggctaagccaataaagtacaaaattcctcaattctatgatccctatggccccagacctccaccctcagaaaaaatcgttcagcttgcagaacaaattgaagcactatcagaagaagaacgtggtcaaattatgcccactttgtcagaaagattaaagcttccaaagttgcagccaatttccacagatggcatggacatgggtacagaaggtggtggtgctgctggactgaaggttgaggagaaaaaggcagagaaaacagcttttgatgtgaagttggagaaatttgatgctgctgcaaagatcaaggtgattaaggaggtaagagcatttaccaacctaggattgaaagaggccaaagatcttgttgaaaaggttccagttgtgctaaaacaaggagtcacaaaagaggaggcaaatgaaataatagaaaaaataaaagctgctggaggagttgcagtcatggagtagaattttgattgttggttgagatcacaattcttcatttccaatatgtttttaagttgccatacgcgtggtgaatgactgttggaagaaaattataaaggcacgaagcagatttaagggttaataaccaattgttgaataatctatttgaatcaattttttcttagttgagttttctggttaattactgtatcacttagaactgctgtgttggtttgacatttgtaacactcgttttgcctatcctctgctcaaatattttcttccagagtgaaatatttctgggatcatagggaaaattactttatggaatttcttttagttatttgagattcctgtgcttgatatactaaacttggtggtcttctttggactggtgcctggtggacctcttatgaagtattgtgcctcctttta

SEQ ID NO: 147 - DNA, 1461 bp, Glycine max
  misc_feature (1)..(1461): Glyma.17g146400.1
aggcattaggccaagtggacctagctttccttccactgacacgttacgaggaccccccttgcattttggaaccggacgtaaacgtttcctccattggacacgtgtgccaactctctctctctctctctctctctcatacattcccattgaggagaggttggggtgcgcaacacaacaccgcaccaaaactctcgttccctgccacaaccggaaacagaagccacgacacacaacacaaaacacaaagcattggtattcggtacgtaacatactctgtttcctctgacttcgaggttttccttcgctttggttcagaccaagcgatctctgtggctacaaacttggaaccatttttatgttttttttcccctgagccttcggttcccatgttcttcgctccaccgcatgttgtaacttgtaaccgcaattccattcctctattctttctcttacccttgagtcacgcacccaccctttttgcctctcacgtagttattgttgtgtgcatgctggtcctacttgattggtgatttttgtagaaactttgatcgatcgatctcttcatcgtcatgacagcttctgcttcaaattcgttgataaccgttaaccctgatgaacttcgcttccaatttgagttggagaagcaaacatattgcgatcttaaagttctgaataacacagagaactacgttgcctttaaggtcaaaaccacttcaccaaagaagtactttgtacgacctaataccggtgttgtacatccatgggacctatgtatcatcagagtcaccctccaggctcaacaagaataccctccagacatgcaatgcaaagacaagtttctcttgcagagtacaatagtgaatccaaacactgatgttgacgatcttccgccagatacttttaataaggatggcgaaaagtcgatagaggatatgaaactaagagtggtatatatctctcctatgtcaccccaaggaagcacagaagatgacacagtgaagaattcaactcaaaaacttgatgctaattctagtgaaaccgtgcagcgcctgaaggaggaaagagatgcctacgtcttacaatcacggcaactgcagcaggaactggacattctgaaaagaagaaatcgtagaggcgattcaggcttttccttcacttttgccgtgtttgtgggtctcattggattattgtgtggtttgcttttaaaactttcattgtcttcaccacctacagaatgatttcacactgatcaaaacctttgcatgcagacccttccgtgctattaagtgtaaagaattattttttctattgaatgggatttttattcattttgcacattttcatggttattacaaagaaccatcaaggcaatcatacctagttactatactataaaactacctagttattgtgtgtgtgcctgtgaaaaagacattctgttcctttgtttatctcttctga

SEQ ID NO: 148 - DNA, 2434 bp, Glycine max
  misc_feature (1)..(2434): Glyma.11g096200.1
aaaactaagaacccataaactatggagcaagttttgtgttttgtattgtttgttgttgtgttgtgttgcaatgttgttgtaaaggaaggaagaaagaaagagcattgggtgagtgactagtgtgagtgatggaggaggaggcatgaccacttctgctacaacttcggtgttgtgggaggaattgatgctaaaagtgaaatggagcggtagcatactgtttgcgtctgcagcaacgacactgtgggtgaactcagacatcggtactatgggagatgacttgcttgtggatttgtggagtcccctgggatcctcaatgatatggagctttccaaggatgatgttgttgacatcaaagatctggaagccaacaaacagaaattgaatatacacattcatcacttaaagactgcttcatctttagcatatgctgtggtttccagaagtgctcacgaaaatctccttcaggctcccttattgtctagatcaaatagcactgaggcttcattggcaaaggataattcctctaatgatgtaaaaaatggtcaagggtacaaaggtcatagtatgcttgctcctttcacggctgggtggcagtcttctgatttgcaccctctgatcatagaaaagtcagagggaagctatgtatatgacattaatgggaagaaatatcttgatgcacttgctggtctatgggccacttctttagggggaagtgagccacgccttgttgatgctgccgttgcacaactaaagaagttgccattttaccattccttttggaatcgaaccacattaccttctttggatctagcaaaggaactcctagaaatgttcacagccagaaaaatggggaaagctttttttgttaatagtggatcagaagccaatgacactcaggtgaaacttgtatggtattataacaatgcgcttggaagaccagataagaagaaattcatagctcgtgctaaatcgtatcatggttcaacattgatagcagccagtctttctggccttccggctctgcatcaaaaatttgatttgccagctccttttgtattacacactgactgtccacattactggcggtatcatcttccaggtgagacagaggaagaattttcaaccagattagccaataatttggagcagttgattctgaaagagggaccagagactattgctgcatttattgctgaacctgtaatgggggcaggaggtgtaatacctccaccatcaacttattttgagaaggtccaagccgttgtcaagaagtatgacattctttttattgcagatgaggtaatatgtgcctttggaaggcttgggacaatgtttggatgtgacaagtacaacattaagccagaccttgtatccctggctaaggcactatcttctgcatatttgccaattggagctgtccttgtaagcccggaaatatcagaagttatacatgatcaaagcaacaaactaggttcattttctcatggttttacttattctggacaccctgcagcctgtgcagttgcaattgaagcactcaagatctataaggaaagaaatattgttgaccaagtgaacaagatcgccccaaggtttcaagatggcataaaagctttttctgacagtcccatcattggagagatacggggaactggcttgattctgggcactgagttcacagacaacaagtcacctaatgatccatttcctcctgaatggggaataggtgcctattttggagcacaatgtgagaagcatgggatgttagttcgtgttgcgggagataacatcatgatgtctccaccatatattatatctcctggagaagttgaagagttaatcagcatttatgggaaagctttgaaagaaacggaaaagaaggtacaggagctcaagtctcagcgcaagtagcttaggcctcatgatggaataataaactctgctgcgcccacttccgggggaaaaggaaatattgtagtaacttgacaagactttgttccaaccttttcgttattgtaaatgtcaataaattggtttcctagttgcttcctaattatatgttgtagttatacatatgcttagaataatgctcgttacacatctccacattgcatgtagcatagcctctcactaatgacgtggcagcatcaatagtgcaagtgtagaaattttagtaagccaaactgtaataaggtgatggaaattgggcgaaggggagaaatgtgtgtacgtttgtgtttgtggaaaacaaaagcaccccgtcgatacgaaggatgtgttgtgcattggccattaaaaaattgtagtgatctagtgtaactaatgactcgtagaaaagcgcgagttagatgtgaacaaggtgtttgcgcaattatcattaagcttatgttattgcaagtccaatactattcaaggtttaattcatttacaagtt

SEQ ID NO: 149 - DNA, 13842 bp, Glycine max
  misc_feature (1)..(13842): Glyma.11g039900.1
ggggccaaagcgacaacaacgtgaccttcaagttccgaatcactcattccttgagaagtttttgtatcctcttttttatttttcttcttatcgccgtcgtcgtcgttttcgtctttcttaatcgccgcgatcgtcgtcgtcgtgcggcgtatatgatcactccgcctcaagatgctggaggatcaggtggcgtacctcttgcagaggtaccttggcaactatgtgagagggctcagcaaagaagctctcaaaatcagtgtctggaaaggtgatgtagagctaaagaatatgcagttgaagcctgaggctctaaatgctttaaaacttcctgtgaaggttaaggcaggttttcttggatcagtgaaacttcaggttccatggagtaggcttggtcaagatccagtcttagtatatttggatcgcattttcttactagctgaacctgcaactcaagttgagggatgcagtgaggatgctgtccaagaagctaagaaaagcctaatacaggagatggaattgaaactgtgggagaagtcacaacagttaaagtcagaaatgaataaatcatggttgggatccctcatcagcaccatcattggaaatttgaagctttcaatttctaatattcacatcagatatgaggatggtgagagcaatccagggcacccatttgcagctggagttatgttggacaaactcttggctgtgacagtcgatgattctgggaaggagacttttattactggaggcgcactagatcgcattcaaaagtctgttgaacttgatcgacttgcagtttatttagattcagatattataccatggcatgttaacaaagcatgggaagatttgcttccttcagagtggtttcagatatttaaatttggcaccaaagatgggaagccagctgataatttgttaagaaagcactcgtaccttctgcaaccggtgactgggaaagcaaagtactccaagctgctgccaactgaagttgctgatagcaaacaacctttacagaaggctatggtgaatttggatgatgttacaattagcatatctaaggatggatatggtgatatcatgaaattagcagacaactttgctgcatttaatcaacgtctaaagtatgctcattatcgtccactggtgccagtaaaagctgattccaggtcttggtggaagtatgcgtacaaagctgtatctgaccagataaagaaggcaagtggaaaaatgtcatgggagcaagttttaagatatgcaagcttgcggaagagatatatttctctctatgcttcactactcaaatcggaccccactcaggtgacaattagtggcaacaaagagattgaagatcttgatcgtgaacttgatattgaacttatactacaatggagaatgttgtctcacaagctgctggaaaaatcggcagagtcaaatcataacatgaggaaacagaaagcacagaaatcttggtggtcatttggatggaccagtcaatcttctaaagaggaaagtgaggaatttaatttcagtgaagaggactggaaccagttaaataaaataataggatataaggagggtgatgatgggcaattggctgtaaatagcaaggctgatgttattcatactttcctggaagttcacatgaatcataatgcttcaaagcttattggggaaaccaaagagtccgttgctgaattatcatgtgaagacctcagttgctcaataattctttatccagaaacaaaggtctttgacattaagttgggctcatataagttatcctcaccaaaaggtctccttgcagagagtgcaacttcctatgactcattagtcggtgtcttccattacaaaccttttgatgacaaggtggactggaggatggttgccaaagcttctccatgttacatgacttacatgaaggacagcatagatcaaattgtgaaattctttgaaagtaatactgctgtaagtcagaccatagcactagaaactgcagctgctgtgcagatgacaattgatgaagtgaagcgcactgcacagcagcaaatgaacagagcattaaaggatcaggccaggttttcattagatttggatattgcagctcccaagattactattcctactgatttttgtccggacaatacccatgctacaaagcttttactggacctagggaacttgttgattcgtacacaggacaactatcaacaggaatcagctgaggataatatgtacctgcgatttgatttggtcttaagtgatgtatcagcatttttgtttgatggtgactatcactggagccaagtttctctgaataagtcggcccattctaccaacagtggtttcttcccaattattgacaagtgtggagtcatcttacaacttcaacaggttcgtttggagactccatattatccttcaacacgccttgctttgaagcttccatcattggcctttcatttttcacctgctcggtatcatcgactgatgcatgtaataaagatcttcgaggaggaggatggtgacagctctgagtttcttcgaccttggaatcaggccgaccttgaggggtggttttctcttctaacttggaagggtgtgggaattagggaagctgtgtggcagcggagatacttctgcttagttgggccttttctttatgtacttgaaagccctgattcgagatcttataagcagtataccagcttacgagggaaacaggtatatcaggttccacaagaacttgttggtaatgtacaacatgttttggttgtttgtagtcctacacgatccatcaataaggttgtggaggacacaaatgcactaattatacgttgtgaatctgaggatttgaagaatacctggcatagttgcttacaacgggctatttattatgcatcgaatacagctcctatttctggtctatctgaaacctcatcagatcatgaggatactgaaccggaacaggataatcatggtatgattgatgtagggattgctgaaagattgtttgtaactggtgttcttgatgagttaaagatttgcttcagttatagttatcagtctgatcagagcttaatgaaggttcttttaaatgaagaaaaacgtttgtttgaatttcgggcaataggtgttcaggtggaggtttctatcagagacaataacattttcgttggcactatcttgaaatctttggaaatagaagacttagtttgcggtagtcaaagatggtctcagccttgttttttggcaagatcttatattgggacggcagatgaaaatttgttattctataataccatgacaagagatgttgaaagtggtgggttaatccctactgaaactgatgataagttttatgaggcgcccgagactttagcagacagtgttgattatcctatgcaatctcctggaggtacatcagaatacccatctagttcgcccagcaagatccaatttaattattcatctctggaactcccaaagtttagtcgcattactggacttctacctagtgacactccttctattaggaaggagcttgaactcaatgacacattggagagttttgtcaaagctcaaataattatctatgaccagaattctgctcagtataagaatatagacaagcaggtgatagtgactctggctaccttgacatttttttgtcgtagaccaacaatcctagccattatggaatttatgaattctattaatatcgaggataagaaccttgcaacttctagtgatagctcttcaacagcagccagaatgataaatgatatatcaagagatgtagatgatctacaagctactgctattgaggaacatgctgttaagggcttgtttggaaaagggaaatccagagttatgttcaacctgacattaaaaatggctcaggcccaaatccttttgatgaaggaaaatgaaacaaagcttgcttgtttgtctcaagagagtttgcttacagacatcaaggtgttcccttcctcttttagtattaaagcagcattggggaatctaaaaataagtgatgatagcctacctagtagtcatttatattactgggcatgcgatatgagaaatccggggggcagatcttttgtggagttggagttcacatcatttagcaacgatgatgaagactatgaaggttatgattttagtctttttggtgagctttcagaagtgcgcattgtctatttgaatcgatttgtgcaggaggttgttggttattttatgggtcttgttccagacagcccaaaaagtgtcgtaaaagtaacagatcaagtgacaaatacagagaagtggttttcagctagtgaaattgaaggatctcctgctgtaaagtttgatctttctctcaagaagcctataatattaatgccgcggaagacagatagtcttgattttttgaagcttgacattgttcatataactgtgaagaacacatttcagtggattggtggaagtaaaagtgaaatcaatgcagtgcacttggaaactttgacagtccaggttgaagacatcaacttaaatgttggaactggatcaaacataggtgaaagcataattcaggatgtgaatgggctatctgtgattattcaccgatctcttagagacttgtcacatcaatatccaagtattgaagtcataattaagattgaaaagttgaaagctggagtgtcaaataaagaatatgaaattattactgagtgtgctgtttctaacttttctgaggtcccacatattcctccaccactgaatcaatattcctccatgacattgaatgatacaacaggagatattgtccctgaggttacaaatgttgttgattcagggaccataaatgttgaagcctctattctactgaaactctgtgtgtccataaatcttgttgagttgagcttatatacagggttaactagagatgcatctctggctactgtacaggtcagcagtgcatggctgctgtacaagtccagcacagcaggaaatggattcctctctgcaacactgcaaggtttcagtgtgtttgatgatcgtgagggagttgaacaagaatttcggttagcaattggaaagtctgagaatgttggagccagtcctctaaatacttcttcgtataatcaaaaccaggactcagtggatagtgttaagggagataattttgatctagttcagacaatgctcattgttgatgtgaaatttggtcaggattcaacatttgtttctttgtgtgtccaaaggcctcagttgcttgttgcactagattttcttctggctgtagttgagttttttgttccaacagttagcagtatgctatcatttgaagaaaataggtcttacatgatggaagctatcatcattgatcaatcagtctacaagcaaccttgtgctgaattttccctatctcctcaaaagcctttaatagttgatgatgatagttttgatcatttcatttacgatggtgatggtggaatattatatttaaaagatagacagggttttaatctcacagcagctagctcggaggctataatatacattggaaatgggaagaagttgcaattcagaaatgttgttattaaggttggacagcatttggattcttgtgtttttcttggagcaaacagtagctattcagctttagaggatgatcatgtctacttggaagaattagttgaaagccctcagtctaggtctttgagaggaagtgtggatgaattaccatctcagaatagtgcagttaacaactccacagaattgatcattgagcttcaggctgttggcccagagcttaccttttataacacatcaaaagatgtaggagggttattaaacctgtctaataaacttctacttgcacagttggatgcattttgcaggcttgttttgaagggtagcaatactgagatgagtgcagatgtacttggtttgactatggagagtaatggaatcaggattttggagccatttgatacatccttgaagtactcgaatgcttcggggaggaccaatatacatttatctgtttccgatattttcatgaatttcactttcagtatcttgagactatttatggctgtggaagatgatattttagcatttttaaggatgacatcaaagaaaatgacaattgtttgttctcactttgacaaagttggaacaataaaaaattctcatactgatcaaacatatgccttttggaggcctcatgctcctcctggttttgctgtacttggtgactatctgaccccactagacaagccaccaacaaaaggagtgcttgccgtaaatatcaattctgtaacagttaagagacctattagtttcagattggtttggcaacttttaacttctgtgggcattgaaggtgaagaagtgaacaattctgacttgttatggaaaactgaggcagatgccatttgttccatttggttccctgaagctcccaaaggttatgttgcactaggctgtattgttactcatggaaagacacctcccccactatcttcttccttttgcatcccgtcttcttctgtatctccatgttctttaagggattgtatcacaattggctctactgatatatccccatccagtgtggcattctggcgagtggataattctgttggcactttcttgccagtagatcctgtttctcttagtttgatgggtaaagcatatgaattgcgttgcattaaatatgattttttgaagccatcctcagcagcattaagtagtctggattcccatgctccttctggtgggcatcaagccttgcaacctgaccagtctgttggtgcaaattctaatagacgctgtgagcctgttgctagctttgagttagtatggtggaatcagggatcaaactcgagaaagaggttatccatatggcgtccagttgtcccaatgggaatggtatattttggtgatatagctgttaaagggtttgaacctccaaacacctgcattgttgttcatgattccagagacgaaaatatttttaaaactccactagattttcagcttgttggacaaataaaaaagcagaggggaatggaaagtatgtcattctggcttccgcaagctcctcctggttttgtttccttgggttgtgttgtatgtaaagggaaacctaagcaaaatgattttagcacattaagatgcatgcgaagtgatttagtagcaggagataaatttttggaagaaagtgtgtgggatacatctgatgccaagcatgtaactgaaccatttagtatatgggctgttggcaatgagttggggacttttattgttcgtggtggtttcaaaagacccccaagaaggtttgctttgaagcttgcagattctaatgtgccaagtggctcagatgctactgtcattgatgcaggaattgggactttctcgatggctctttttgatgattacagtggattgatggttcctttgttcaatatatctttgagtggaataacatttagtttgcatggaagaactgggtatctaaattgcactgttggtttctccttggctgccaggtcatataatgataagtatgaagcctgggagcctcttgttgagccagtagatggattcttaaggtaccaatatgatctcaatgccctggctgcaacctctcaattacggttgacatcaactcgagatctgaatttaaatgtttcagtttctaatgcgaatatgatcattcaagcttatgcaagctggaacaaccttagtcatgctcatgaatgttataaaaacatagatgcattttctccaacttatggtggaaactctatcattgacacactccacaagaaaaattattatataatccctcaaaacaaacttggtcaggatatttttattcgtgttactgaagctcggggtctccaaaatataattcggatgccatctggggatatgaaggctgtgaaagttcctgtgtcgaaaaatatgctagaatctcatttgaagggtaaactctgtagaaagattagaacaatggttacaatcatcatagcagaagcacagtttccccaagttgaaggttcagattcccagcaatatacagtggctgtccgcctttattctaatcagagcctccctagtgattcatcggtttatcaacagagtgcacgcacacgtggacgaagggcacatcatttattgccttcagatcttgagttagtcaagtggaatgaaatatttttcttcaaagttgattccctggacaaccactccttagagttaattttaacagatatgggtaaaggtgttcccgttggatttttttcagcttccttgaacgagatggcaaaaactattgaggactgctcatatacccaaaattttgccaataagttgaactggatagatttgtctgcagaaaactcaatggatgctttttctaagaagccttgcaaattacaatgtgccatactagtgcataattctgaagtcgagactaacaatcaactatctaattatgatgcccataaatctgggtttattcaaattagtccaagcaaggaaggtccttggacaactgtgaggctgaactatgctgcccctgctgcttgctggcggttaggcaatgctgttgttgccagcgaagctagtgtgaaggatggaaatagatatgtgaatattcgatcactggtttctgttcgtaacaacacggattttgtgcttgatttatgccttacttcaaaaagtttgtcagaaaaggggaatttgctgaaaaattcaattaattctgaatctattcatacagagagctacagaattcagacagatgagttttttgaaactgaaaagttaactccacacattggttgggtacactgttcaggttattctgagaaccaaatgtcagacaggggaaaatctcatcaggtttttcctggaattgatctaccgccaggttgggaatggattgatgattggcatttggatacaaaatctcccaatacttctgatggatggatttatgctcctgatgtggagagtttgagatggcctgaatcctttgatccaaaggtatctcttaattctgccaggcaaagaagatggctaagaaacaggaagctaatagcagaggatcttaagcatgaaatatcagttgggcaactgcaaccaggagaaactgctccacttcctctatctggtttgacacaatctgtacaatatttcttgcagttaaggccctcagaaaactcttgtgagtactcatggagtagtgtagtggacagacctaggcagccagaagaaattggtaggggaggtcaatgctcaaatctgtgtgtttcagctctttcagagtcagaggaacttttgtgttgcagtgaggtgcatggaacctctggtggctcccacaagttgtggttttgtgtaagcatacaagcaactgagattgctaaagacatccattctgatgccattcaggattggtgtttggtggtcaaatcacctctaataataagcaattttcttccccttgctgctgaatattctgttcttgaaatgcaatcaagtggccattttcttgcatgctcaagaggagtatttttatctggaaaaactgtacatatatacagtgctgatattaggaatcctttgtttttatctttgcttccacaaaggggttggcttcccatacatgaagctgttcttatatctcatcctcatgagaatccatcaaaaacaattagtttgagaagttcaatatctggaagggtgatccaaataattcttgagcagaactataacaaagagcacaccttgctggctaaaacaattagagtctatgctccttattggttggaagtagctagatgtcctccacttacatttagacttcttgatatgtcaggaaaaagacatatgccaaagtttaactttaatatcctagccctttcagtggctattgcccaatcaggaaatgagcattttggacctgttacagatcttgctcctcttggtgatatggatggctctttggatatatatgcatatgatggcgatggaaattgcttgcggcttattatttctacaaaaccatgcccctatcaatctgttccgacaaaggtaatttctgttcggccatttatgactttcactaatagacttggtcaagatatattcctcaaattgagcactgaagacgaaccaaaggttttgcgtgcttctgattcaagggtatactttgtgtgtcgtggaactggtggacctgaaaaactccaggtaagactagaaggtaccacttggtcatttcctcttcaaattgtaaaagaggatacaatctcccttgttttgaggatgaatgatggcactatcaaatttttgagaactgaaatccgtggatatgaagaaggatcccgttttatcgtggtattccgtcttggatcaactgatggtcctatcaggattgagaacagaacgacaaacaaggtgtttagcattcgacagtctggatttggtgaagatgtttggattcatttgcaaccactgtcgaccgccaacttttcttgggaagatccatatgggaataagtttttagatgctaaacttagtgatgatgatagcaacacaatttggaaacttgatttggaaaggactggattatcttctgcagaatttggattgcaattccatgtgatagatagaggagatataataattgcaaagtttaccaatgatgggatgccgagttcaagttcgtatgaagagattagaggcccaatgtcttctggaaaagggggagtttctggtgttcaggctgaaatgcagagcagtgttactccttttgagctcttaattgagttaggggtggttggaatttctatggcggaccatagatcaaaggagctctcatacttgtacttggaaagggttttcttaacatattcaactggctacgatggtggaaagacaagcaggttcaagctcatatttggttatttgcaactggacaaccagcttcctctaacattgatgcctgtgctcttggcgccagagcagacctctgatgtgcaacacccagttttcaagatgacaatcaccatgcagaatgagaataaagatggaattcaagtttacccatatgtttatatacgagtaactgacaaatgctggaggcttgagattcatgaacctattatttgggctatcatggacttctacaacaatctgcagctagatcgcttacctaaaagttcaactgtcacagaagttgatccagagatacgttttgacctaatagatgtttcagaagtaaggttgaagtttgcactggagacagctcctgggcaaagacctcatgggatcctgggcatatggagtcctatactttcagctgttggaaatgccttcaagatccaggtgcatctgaggagggtgatgcacagagacagattcatgcggaaaagttcaattgttccagccattggaaatcgtgtttggagagatttgattcataatcctttacatttaatattttcggttgatgtactaggtatgacaagttcaacattggcttctattagcagagggtttgctgagctatccacggatggacaatttctacaattacgtgcaaagcaggtaagatcaaggagaatcactggggttggggatgggttcattcaaggaacagaagctcttgcccaaggtgttgcctttggtgtctctggtgttgtgagaaagcccgttgagagtgcccgacagaatggtatcctaggattggctcatgggcttggacgtgcctttttaggtttcattgtgcaaccagtaagcggggcacttgattttttctcattgactgttgatggaattggtgcaagttgttccaaatgctttgaggttttcaacaacaagactgcattccacagaattagaaatcctcgggctgtacattctgatgggatactaagagaatattgtgagagagaagctattgggcagatggtgctttaccttggagaggcaagccaacaatttggctgtgctgagattttcaaggagccttcaaaatttgcgttgtctgattattatgaagagcattttactgtgcctcatcagagaattgttttagtaaccaataaacgagtcatgcttcttcagtgtcttgctcccgacaagatggataaaaaagcatgcaagattatttgggacgtaccttgggatgagttgatggcactggagttggcaaaagcaggcagttcccaaccttctttcttgatcctccatctgaaacatttccggagatctgaaaattttgtgcgagtgataaaatgcaatagtgtggaagtgtttgaaggaagagaaccccaagctattaagatatgttcagtggtgcgtagagcatggaagacatatcagtctaacatgaaaaacttgattctgaaggttccttcaagtcagagacaagtgcatttttcctggactgaagttgatagtagagaaccacgaatccccaataaggccattattagttctagggagatttcatcaaacagtactgcatctgatgatagacgatttgtgagacacatcattactttttcaaagatctggagcagcgaacaagaatacaacggtcgatgctcgttatgcagcagaaaacagatctcgcaagatggcagaatatgtagcatttggaggcctgtgtgtcctgttggatatatatatattggggatattgctcgtgttggtatccatcctccaaatgttgctgctgtctaccgcaagattgatggattttttgctctcccgatgggatatgacctggtgtggcgaaattgtccggaagattatgttactccattatcaatttggcacccacgggcaccagatggatttgtggctcccggatgtgttgccattgctggttatttggaaccagagcctgatcttgtttactgtatcgcggagtcacttgttgaggaaacagaatttgaagagttgaaggtttggtctgcacctgactcatatccatggacctgtcatatctatccagtacagagtgatgctttgcattttgttgctctacgacaaagcaaggaagaatccgactggaagccaaagagggtccgtgataaccctcactgtcagttgcaatcaccttagtctttaaactggttaacctccgttttttatttctttggaggtcagctccaaagaatgtgcgtgtgccatctccgaaagaagacagtaatgtaagttggacgatgtttataataggagaggctgtgtttgtcgcgtgattattattactactttccagcatccaatggtgatgggactcagattgggatcatgtatattctctctgattctgtggtatatagtgtataaaagcaccacgtcggaaactgccaaaaggcacatgtaacttgtctacttatccttgtgtgtgttttgctcatgtctcagactattttgcgaagatgcgttggcgttttctttttcaaaagccacatacatacttgatttgcgagggatagaatattacatggttgacaatctaggcaaagactggccaccgaggtctatttttgaagatatgccaattttatgatgcgattcgaacattatatttccatggctcaattgatgaactatgtccttgagcgaaaactctgcttgacaaattgtgtgcatagccttttcttggttgattccatactaaatttgtaaattaggattattttttgtcttagattaatcatgttgcatattgaaataatcaagttgtttaatgagcgatctgattttgggttttcaaacattggtattcgaaagttaatttttactgaagagttgagtgaatcc

SEQ ID NO: 150 - DNA, 1622 bp, Glycine max
  misc_feature (1)..(1622): Glyma.05g053000.1
tcatatggttatggtgagaaacaaagcccaaagcccatgtgatgttcgtgcacggtgaatgatatctcttggctatacacttataaatactagagagttctaattccagaattgaattacgaattatccaaagaatctttataaataggggactatattttttgtttaaagtaaattcatcgatctttcacttccactttcgtttttctccctctcaggacatcctgtattaacagtgaaaagtgcatctgaagagacagaatgcaaggacccgggggtggcagggatcgtttctttgattttggcgatccttttggtggttttggaggctttggttcctttggacctcccaggagtttaatctcaagcttttttgggggtagggacccatttaatgatcctttcttcgcccgaccttttggagggatgtttgagtctagtccctttggtggtcctactggatttcctttcccccctggtatgaatccatctgggttccttgagcatccagccccgggtttggatccatctggcttccttgtgcgtcaagctccagagcctagtagacaaaggaggggaccaatcattcaggaattgaactctgatgaagaaaatgaggaagcaacggaggagaggaaaggcaatccgagaaagcatggtaggtcagacagtgaaccctctgttgaacatccagatgatgaaattgaagggaagaggagtagactggctggaaatgagagcagaatcaatataactgggcctcggcctcaatctcacagcttctgcttccagagctcaactgtcagctacggtggtccaaatgggatgtattatacatcctcaagggcaaggaggagtggaagtgatggagtgacctttgaagagaggaaggaggctgatagttcaacaaggaaagcttctcacctaatttctagaggcattcgtggcaagggacattctctctcaagaaatctgaattcagatggtagggtagatactatgcagactctgcacaatataaatgaagatgagcttgctggctttgaagaagaatgggaggaaaagggtcaaaagtatttgcctggatggactggcagtgttgaagctagcggtagtaatagacaagcagtgcaggccaggcgcggaggttgggcactcccttcttcggagcatagtcatgccgtgggaacaatatctgaagctagagatgaagttggtcctcgcacacaggagagggttaggacaaattcaactggtaggaatgcataccgtccaggagtagagcgtggccgaaactaaggccctaatgttttgctcaaatacctgactcccaaattaaccatctactaacccctctgcaatcttcatgttagtaactgatagtgtgcttcttccttttccctatatagctatatgaccattttggccgttactcttatgcttttattggatgggtttgtccattgaaattgttatggtgatcataggggtctgagacctgaatgcataacaaaatttatagctgtcattcatgaggcatgaggtgtttagttgttttatggtgcgcatgattacttgcaccatatccagaatatattatatcggtgaggtaggggcgtgac

SEQ ID NO: 151 - DNA, 1338 bp, Glycine max
  misc_feature (1)..(1338): Glyma.20g104000.1
gtggccacaaataagcgaaaaatatatttgggcaatgcaaagcctaacactggtcctctcatagtcatgaatctatcataactcttcctttccttttatcgtttcatccagaaaacatggatgccatgacactgtcactcccgctccctccggttccggtctgtacagtgcccgcgtctgcatcaacctcgtcctctgtttctctcactcactcctggtcggccacggccaggcagaggctctcctctcacagaacaagacccattttccggaattattcctctgcggttccaaaacttacagtggtgacatgcggtgcggctgtgacggagatcaacgagacccaattcaaagacacggttctgaaggctaaccgtccggttcttgttgagttcgtcgctacttggtgcggtccttgccgtctcatctccccctctatggaatccctcgctaaggaatatgaagacagattaacggttgtaaagattgatcatgatgccaacccacggctaattgaagagtataaagtttatggactaccaacattaatactcttcaagaacgggcaagaagttccagaaagcagaagggaaggtgcaattacaaaagtgaaacttaaagagtacgtggatgctctattggaatcgatatcagtttcatagtcatcatattcatatatgtttcaaagttctgacctgttctgggagacttgagatataggagcatatctgtttgtttccatatccttgtattgtatgaaacagtttaacaggcttatacagttgtataatctatataatttctgaagctgtaaatacagcataatgtggtgaaggaaggttgtgcttaagggtttctacacggggttggaactcattcattttaaatccaaaaataaaatttgatcgagtcaaatatgaagaaaaataaaataaaaattgaaaaaagataagtatttggcaggataattgggttccaaactgtggtggccttgttgattgcttaattgaggaggttggtagtatttctttggacataaaggtgttgaattcagtcagagactttattccaactacggtgactaattctatctaagctttggttcccacttcccccaagaccaagagggcatggtaaagggaaaattaacttggagcaagacaaatgatggcatcttctaaggcaggattgttgtgtattttgattttgattctagcaatgctattaatttgctgactaatggttgttgcaatattcatccttgctataatttggcgaagtccattcatgatattcatcagtatagggaccaaatcaactggactcatgtaccaagaa

SEQ ID NO: 152 - DNA, 2217 bp, Glycine max
  misc_feature (1)..(2217): Glyma.14g018300.1
acgctgcgtttctctctttctttcgtctattcttttcaagcttcgttcttttcttaagcttcactgtgaacatttccctttttctctctcgataatcgcattttcttgctacttgttgctgatcattgggttattgtagcttccgtttcgtctactcatttcattctgttgtgatcgttagcttaattagcttaccctgcattggattatgatcatgtcatatgctaggtgtcgctgggacttcaatggcagtgactgaagctcagaatcctcttcttggagaaaacacatgtggttccttgttaaaaaagcttcaggaaatatgggatgaggttggtgagagcgacgagcaacgagacaagatgcttcttcagttagagcaggagtgcttggatgtgtacaagagaaaggttgagcaggctgccaagtcaagggcgcagctacttcaagctctgtctgatgctaagcttgagctttccactcttctatcagcacttggagaaaagagctttgctggaattcctgagaatacttctggaactatcaaagaacagcttgcagctatagcaccagtacttgaacagttatggcaacaaaaggaagaaagaattaaggagttctcggatgtacagtcacagatccaacaaatatgtggagagatagctggaaacttgaaccttaatgatgtttcacctgcagttgatgagtctgacctgtccctgaagaagttggatgaatatcaatctgagctccaagaacttcaaaaggaaaagagtgagaggttgcacaaggttcttgaatttgtgagtactgtgcatgatctatgtgctgtccttggtatggacttcttcagtactgcaactgaggttcatccaagtctaaatgactctactggtgttcaatcaaagagcataagtaatgacaccctagcaaggctggctaagaccgtcttaacgctgaaagaagataaaaaacagaggctgcacaagctccaagaattagcttctcagttgattgatctttggaatctaatggatactcatcccgaggaaaggagactatttgaccatgttacctgtaatatgtcagcttctgttgatgaagtcactgttcctggtgcccttgctctggatctgattgagcaggctgaagtggaagttgagagacttgatcagctgaaagccagcaggatgaaggaaattgctttcaagaagcaagcagagctcgaagagatatttgcccgtgctcatatagaagtagatccagatgctgcccgggagaagattatggcattgattgattcaggaaacattgaactaactgaattactggctaacatggacaatcagatagcaaaagcaaaagaagaagctgtaagccaaaaagatatattggacaaggttgagaaatggatgtcagcatgtgatgaagagagttggcttgaagactataaccgggatgagaacaggtataatgcaagcagaggtgcacacataaacctcaaacgtgcagagaaagcacggatattggtcaacaaaattccagctttggttgatacattggttgctaaaactcgtgcatgggaagaagatcatggtatgtcatttacatatgatggcgttcctcttcttgccatgttagatgaatatgccatgctcagacatgagcgggaagaggaaaaacggaggatgagggatcagaaaaagcatcacgagcagcgaaacacggaacaagaaaccatctttggttcaagacccagccctgctaggccagttagttccagtaagtcaggaggtcctcgtgctaacggaggagccaatgctactcctaaccgacggctatcgcttaatgcacatcaaaatggaaacaggtccacatcaaaagatggaaaaagggaaaacagactatctgctcccgtgaattatgtggccatatcaaaagaagatgctgcttcccatgtttctggtactgaacccatcccggcatcaccctaataacgagatcttcattttcaaccctataatttcatctttgtagcattgtcaaattactagttactgctttaggaattataatatgggagtgacaagtaattagagagatactgttctgagctgtgtatgttcaatttgccatttggaggttttctgaatacatatgccctataatatgaaaatatacagtcttcagtgctagtcttgcctttttccaaaccct

SEQ ID NO: 153 - DNA, 4032 bp, Glycine max
  misc_feature (1)..(4032): Glyma.08g265300.1
gaaaacaacataccaaatacccttccctgtcgtgtgcccttcttcatcagtgttactgcgcatccttccgtttctaccaccgactccggggaaggaaagaaggaaggaaggtgtgaacaacaatcccagcccaacacccatgagaaacgagttgttcgtcgttggattcatgttttagctgctcctcactctctcactcgctttttggtctttgtctgctgatgcaaggatgagttcgttctccatcacgcggaaaaagacgccgttccagaagcatagagaagaggaggaagcaaagaagaagagagcagaagatgagactgctcgcctgtatgctgagtttgtagagtcatttcaaggagatactactcctgggtcaaagacttttgttcgaggaggaacaattaatcccaatgataaatttaaagatgattctgagggtgaaaagtctaaagatggggtatctggtccaaagaagggaagtaggtatgtaccatcttttattcctccgccaatggcaaccaaaggaaaagaatctgaaaggaaaaaagaggaggaaaagctaaaggagaaagagaaagggaaggcaagaaacattgatcattttatggaggagctaaagcatgagcaagagatgagggagaggcgaaatcaagaacgtgaacattggcgtgacgggcgtcttacagaacattctatttccagtcgctttgatgagctgcctgatgactttgacccaagtggaaaacttccaggatcatttgatgatggtgatcctcaaactacaaatctttatgttggaaatctctcacccaaggttgatgaaaattttcttctccgtacttttggaagatttggacctattgctagtgtgaagattatgtggccaaggacagaggaggagagaaggcggcaaagaaactgtggatttgtagctttcatgaacagagctgatggacaggcagcgaaagatgaaatgcaaggagttgtggtttatgaatatgaattgaaaatcggatggggaaaatctgttgccctcccatcgcaagcactacctgcacctccaccagggcatatggccatcaggagtaaggagggtagtactgtgatcttgtctggtccttcaggtccgccagtaacatctgttcctaatcagaattctgaactggttctaactcctaatgttcctgatataatggttacacctcctgaggatgaacatttaaggcatgtaattgatacaatggctttgcatgtcctggatggaggatgtgcttttgaacaagctattatggagaggggtcgtggcaatcctcttttcaacttcttgtttattcttggctcaaaggaacatacctactatgtttggaggctctactcatttgcccagggtgatactcttcaaagatggaggactgaaccttttatcatgataacgggtagtggaagatggattccgccccaattaccaatgtcaaaaagtccagagcatgaaaaggagtctggttccacacatgctggaggaagaagcaggcgtgtagagcccgacagaacactgactgatgcacagagggatgaatttgaggatatgctgcgtgctttaacattagagaggagccagataaaagaggctatgggattttctttagataatgccgatgctgctggcgagatagttgaagttttgacagaatccttgacacttaaagaaacccctattccaactaaaattgcaaggcttatgcttgtttctgatattcttcataatagtagtgctcctgtacgaaatgcatcagcatatcgcaccaagtttgaagcaacattgccagacataatggagagttttaatgacttgtatcgtagcattatgggacgtatcactgctgaagccctaaaggaacgagtgctgaaagttttacaagtttgggccgactggtttctcttttcagatgcttatgttaatggattaagggccactttccttcgacctgggaactccggtgtaattccattccattccatttgtggtgatgcgcctgagattgagcagaataccacttccaaagatatggttgttggtggcaagaccaaccaagatgctgcattggcaatgggtcgaggggctgcaatgaaggagctaatgagtcttcctcttgctgagctggaaagacggtgccggcacaatggattgtcacttgttggtggtagagaaatgatggttgcacggttgctaagtcttgaagaggcagaaaagcagagaggttttgaactagatgaagaattgaaatatgcccacaaccaagtgagttctgggaaatattcaagtaatcaacgagaaacaagtgaagagcctgacccagtatggaaccactatggggatgaagatttgcagtcacagggcagaagttctgtacctttatccccaacacttcctattgcacaacctgaacttaaagctttcacaaaaaaggagaagaatgatccagttctgccagcctctaaatgggcttgggagggtgatgagagtgatgatgaacaaaggagaagtggaaaaaatatcggcttaagctactcatcttctggtagtgagaacgtgggtgatggtcttgttaaagctgatgaatcagagtctgcagctgatacacgtttttcagctcatgctgacagtggaatgaatgaagagcagaggcaaaagctgagacgcttagaggttgctttaattgaataccgtgagtctcttgaagagaggggagttaaaaatttggaggaaattgagaagaaagttcagtcacataggaaacggctgcaagtggagtatgggttatcagattctggtgaagatggtcatggccatagaagaacttcagagaggagggattggaatgatgtttcaaggaaacggcatcgaagccctagtccaagtggtagtccactgccaaaattatatggcaaggacagagatagagaacaccacgatttagaaagggatcgagacagacaaagagacagaagtcatgatttcgatagtgaaagaggaagggaccggcaccgggaaaagagtggaagcagagagagagatgatcatgataaggatagaagcagggatagagacagggacaggagaagacgagccaaataagaacatttcagatgtttcagcagagatttgataccttaatgatttgcaaattggcttgtaagagtcaggaggacagttggcttttcgtcatcacagggatattggcaatgtgaaacctcctgttgggagataggaatgaaacatctgccaggatagtgttactgtggacagtctttggaattgctgagtagtaactggctcttgataccctccataatttcaacttcatgtaatattaagattttaaatcgataattttgcctgtgaattagtgcttgctgctgcacactgcatacctgatcaagagggttctgtcaataccaattgttgagatagtttacagggagattcgtgcgtgcgtgcttgctgggtaaggcgtagtttaaaacatttagggatgttatggtttattgggtaatgatacatcatagtattgtggacgaattttgaattcctaggctagttattttgataaaatcaacattttcgtttacctattggacgtatttcaacatagtatagatattctttttcttgctgatataaatattttttgttcttgttcaggtacacaactgagtgacatgcggttggatctattgaaactgactcttctagtagttgttttttagtttatgaagttctttatggttttagaaactcgtggatgagtttgattgaatagaacttcaactgtaggataacaaacctgtcttaagatgtgaaaattattgatactaaaagcatttatttacatgacatgttaatggagagggaaagttatgttttagtgattatcaaagtaacacgtggaaatagtggggggaccaagtctgatgtgttgactaagtttgcttattctcttgatggttaaataagaatgagtttctacc

SEQ ID NO: 154 - DNA, 165 bp, Glycine max
  misc_feature (1)..(165): Glyma.13g225300.1
atgaagctattgcaatattcagtagcttgccaaaaaaaaacatcaggtcagaagacaaaattacacaacaaaagatcaaatgtattcatctcctgtgatctctatcctaagcatgattccaatctaacaaatcatagatcgaatcaacaaaacaacaacaattag

SEQ ID NO: 155 - DNA, 2549 bp, Glycine max
  misc_feature (1)..(2549): Glyma.18g044200.1
gaaaatagaacttcaacgtctgacgtgtcaccctgtcgttgctccttccttcttttttttcctcacaacaatcacaagaagcactttcggagtctgagctttcacttcttccaacttcttcatctatctatatacttctcttgtaacctctcatctttacaataacactttttccctcagaaattaaccgtttttcctttctgggttttgtataattttgttgattttccattccttctatttttttgctgctgctaagtagcagtggtatgtatgacttatgagctttgagcctctttatattttgaaaagaagattggaattttttttcttcttttgggaaaggcttctagtggttggatttttgtccatcaagttattgatcgaggagggggttatcacttatcaacctttggtagtgcgtgatcacgggatcttgtagatgatggagagggttttttgtgctttgtgattctgagatgtgaattaatggttggtgaagtaaagaatcaaggcagagtttgcatgataaatttgacttttggatcgaggtgggtccatttttgtacacaatttgttgtttgattctgtttccagctttctaagggagagatgggaggagggtggaacttgtgattttcttgtttgtgttgtacttttcttgatttcggaattcgtatccagaaagaggagttttagtacttaggtgttgtgatctgattgtaaggagggaagcaaagttgaggaagtttggaacttctgtgaagagggaggagaagatcttgattcttgacaagaggttgtttctgcagctatggcgattcaagatcaaaatggatttaacagatcacagggtggtcctccaataggaggaggagtatctttgagttctggagtgcattctgtcacacatattcaacttagtgaccagttttcttgtggcaatgactatgctctgaaggtaagaaagccttatactatcaccaaacagagagagcgatggacagatgaagaacataagaagttccttgaagctttaaagctgtacggacgggcttggcgacgtattgaagaacatgttggcacaaagactgctgttcagattcgaagtcatgctcagaagtttttttctaagcttcttcgcgatcctactgggaacaatacaaacacagtggagtcaattgaaattcctcctccaaggccgaaacgaaagccagtgcatccttaccctcgtaaactagttgagacccctaataaagaaattttgatcccagaacaacttatgaagtctaattctctgaagtcatcagactttgatcaagaaaaccaatctccaaaatcagtattatcaggagttggttcagacagccttggctcctctgattcagacacaccatatggaagtttgtcgcccatgtcatccattagtggcatccatacaagcagttttacacgtgctgagcacaaaacaacatctgatgaagctgggatggacactgattcagctcatgatgagaaacctcttatgaaattcaagcttcctccaaatgaatgtgtttccatcaaagatgacacagcagaagaatcttccggtcggactttcaaacttttcggaatgactctatttgtaacagacacctgcaaaccatctccaacaatcgaggcatgcaaaccgatacctctaaacattcgtgtgcgatgcctttcctcctccatgggggatgatggcaaattggaacttcgtggccactctacagcaagtgaaacatcagcaatatccaagctaaaggtgagagtgggacctgaagcatgtggtaaagggtttgtgccatataaaagatgcatatctgttgtgacagctgataatagagaagagcaatgcatccatctttccttgtagcttaccccactggatatttcttcaaaagggttccctttgagatgatgagctgtaatggttgttttagctgctggatgtgagttggcataaaatagggagctgaaaattttgacatttctgttgcattacactgcacattctccagctgttcaaatccgtgaacttgccttttgtatttttttgactttcaagtttcaactgtgaattatatctagtgtttttgtttgtttttttttaaaaactttttatgctccttaagagtatgcaaagtgtaagtcacgtacttgtgcagtgcttattaacgtacttgttcatagattctgcatttactaccatgatgggaattttttctaacgaggcatgttttgtggatttcggaggtgggaagatccattggcctaacatatattttggggataaattgaatcgtaggctttagggaataataaaatatatgtagaacagaaatgctattttttctgggtattattctttagctagaaactaatctttcaattagtgagatacattattgggggtacttactttatttagcgagatctatattagtttagaatgtgttgataagagaatgctggtatcaatcttcaatccttccatatattgtaaaaccatatttcggtcaaag

SEQ ID NO: 156 - DNA, 1588 bp, Glycine max
  misc_feature (1)..(1588): Glyma.08g344800.1
tatttctctcaccattatcatttacaccaattgttgttgttggtaataaacatggatattgatatgacgatttacttgccttgatgaaccaataagagcatgtttggttctcgagtggggaaggccaaacttatggcccgagacactcctctgtagcattttcttgaagaaaggaaaggaaacggcatcagttcagagagatcagagatgtgtgggagagcacgttgtactctgagagcggatgatgtcccaagggcttgtcaccgcagcacttcccctactcgcactcttcatatcgaccggtataggccagcgtataatgtgtcaccgggattcgacgtgccagtggttcgtagagatgacgcgtctggcggtgaaggctatgttcttcaatgcatgaaatggggtttaatccccagttttacaaagaagacagagaagcctgatcactacaggatgtttaatgctcgatctgaatctatagatgaaaaggcatcatttcgccgtctgcttcctaaaagcaggtgccttgtggcagtagaaggattttatgagtggaaaaaggatggttcaaagaaacagccttactatattcacttcaaagatggacgaccacttgtctttgctgctctttatgactcatggcaaaattctgaaggtgaaacactatatacattcactattgttacaacctcttcatcttcagcacttcagtggcttcatgacaggatgcctgttattttgggcagcaaggaatcaactgatatttggctaagcagttctgcttccagttttaagagtgtgatgaagccatatgaagaatctgatttggtgtggtacccagtgacatctgctatgggcaaggcatcatttgatggacctgagtgcataaaggagattcaagtaaaagcacaagggaacacttcaatctctatgttcttttcaaaaaaaggagatgaaagtaaagacacaaagccagaacagaaagcatcatgtcctgaagttgtcaaaactgaacatacagaagacctgactgaaagtaaagacacaaagccagagcagaaaacatcaagtcatgaatttgtcaagactgaacctacagaagacttgagagaaagagctaaaactgaggagggaggcaatgacttaaaattccatggttcttcccattctcaaaatgtttctatgctcccaattaagcgtgagtatgagacattttcggctgctgattcaaagccagcattggcaaatcatgatcagataagtccaaaccctgcaaagaaaaaggaaaaagcaaagactgctaatgataaacaaccaaccctgttttcatactttggaaaaagtaaccactaaactaactggttttggttttgcattaacatgaggattgctatgtttgtattggtgtaaattacacatgcattttcttttagcttgtgtatttccatgtaggccttgttttatatgcacattttcaatctctactcttgttggaaggtctttctttagtccatggttcatgttcaagaggagctttataattaaatagcaaggctttttgtattattttggttttgctggttac

SEQ ID NO: 157 - DNA, 1852 bp, Glycine max
  misc_feature (1)..(1852): Glyma.10g104300.1
attcactcactaataagatttttccatttaaaatattttccaaagtccaaagtcaaacacaatcaatgattcaaatagcatcgtgtgttcactctgtttagtagcatccaaaatggcgcattcttctgttatagtcttcctctgcactctccttctcttcttttctccgtcaattcgtgcctccgacgatgacgtggcgctgcacgcgaagaagctcatcagagacctcaacttgttccccgacgctgacgtcaacatcgttcccgttgctaattgcaccctccaaccccgcaggatcgtcgagaagcgcctgaggttcccgaagctgctagcttcggattccgagccttcggttgaggatttgggtcaccacgctggctattaccccattcagcattcacatgccgcaaggatgttctactttttcttcgaatcacgcaataggaaggaggatcctgtcgtaatttggttgactgggggacctgggtgtagcagtgaattggctttgttttatgaaaatggccctttcaaaattgctgacaacttgtctcttgtgtggaatgagtatggttgggacaaggcatcaaaccttttatatgttgatcaaccaactggaactggctttagctacagttctgatttgcgtgacattcgtcataatgaagagggtgtcagcaatgacctgtatgactttattcaggccttctttgtagagcatccccaatacgccaagaatgacttttttattacaggagaatcatatgctggacactatattcctgcctttgcaactcgtatccatcgaggaaacaaagctaaagaaggaattcatataaacctgaagggattggccattggtaatggacttactaaccctgcaattcagtataaagcttaccctgattatgcactggaaatgggcataattaagaaggctacacgtaacctccttaacttagtattggttccagcctgtgaatcggcaataaagctgtgtggcactaatggaaagacttcctgtatggctgcatatgtagtttgtaatgtcatattcagtgacatcatgttacatgctggagatacaaattactatgatatcagaaaaaagtgtgagggaagcctttgctatgatttttcaaacatggataagttcctgaaccaacaatctgttcgggattcactaggcgttgggaaaattcattttgtttcttgtagcactgaagtttatgcggctatgttggtggattggatgaggaatcttgaagttggtattcctgaccttcttgaggacggaatcaatttgcttgtttatgctggggaatatgatctaatctgcaactggcttggtaattcaagatgggttcatgccatggaatggtctggtcagaaagagtttgcaacctcacttgaagttccttttgttgttgatggatcagaagccggattactgaagagctatggacctctaagtttccttaaggtccataatgcgggtcacatggttccaatggaccagcccaaggctgcattagagatgctgaagaagtggattaatggaacccttgctgaacctagggatgataaggaaaaattggttgctgagatgtgatctcttttattgcttatttaattagtctagcaaaagggaacataaatgagaaaagaaattgcagaagtgtgacctgtatgtagtttgtgtgatatgataccacccccacagcacaattctaaaatgacattgtactaagaacttctatcatggaagaaaacctactattctaaaggaattccgtattttctgctttacatgctttattttgtttcacataagatcagatttatgtgtgtattt

SEQ ID NO: 158 - DNA, 3167 bp, Glycine max
  misc_feature (1)..(3167): Glyma.10g104900.1
ctcactcagtttatcgaaaaagaggtcttaactaatatattgatgattttgttgttacttgaattttttatattatgtattattttcagcacaatcctggattacctgctactcgtcatcgtaggatagcaagctctttcagggataactctctttttcagatattccagatatcattaacttctctcttccagttaaaatctgatgctgggagcaagttgcaggagctgtctcttatgctttcccttagttgtttatcatttgattttatggggacatcgtatgatgaaagttcagatgaaattggtactgttcaggttccatctggttggaagcctaccctagaggattcctcaacactgcaaatcttttttgattattatgcaatgaatcaaatgttttcgaaagaggcattggagtgcttgttgcgtcttgcttctactagacgatcattgttttccaatgatactgctcgaatgaagtttctgtcacacttgatgctgggcaccaaagaaattttgcaaactggaataggtcttgctgatcatgataactatcatgccttttgtcgtcttctcggccgctttaaagtaaattatcagttatccgaacttgtgaatgctgaaggctatagtgaatggatacgcttggtagcagagtttacattaaaatctttgcattcttggaagtgggctggcagcagtgtttactaccttctaaatttatggtctagatcagtgacgtctgtgcggtacctcaagagtgacaaacctaacctgttagatgaatatgtgcctaaagttattgaagggtttgtatcatcaagatttgattcattgcagtctgaactatcagatgaacttggtgaaaatcctcttgacaatgttgaagtacttcaagatcagcttgaattttttcctttcctctgcagattccagtatgaaagttgcagttcgtatttgatgaagatagtggagcctatcatgaaaagctatatgaacgaaatccatgtggatagttatgaactctctgtaactgaatccaaacttgcttggttcacacacatagttgctgcaattctcagaacaaaacagatttctggttctagtggagaatcgcatgagatacttgatgcggagatttcagcatgtgttctgcagttgattaatatttgtgacagtgggtttcacagtaagaggtatggagatgtgagcaagcaaagacttgatcgtgctatactaactttcttacagcatcttagaaggtgttatattggtgatcaggctgtgtattcttccaagcagttatataccaggctatctgaacttcttggactgcatgatcatctcctactactaaatgttattgtgggaaagatgactactaacctaaagtactacactaagtgcaaggaggttattgatcataccttaaatctctttctggaaatgacatctggatacatgtcaggaaaactgcttcttaaattggatactgttaaacacatactatcgaatcagaatagggaccaattccctttcatagaaaattgggaatgtttccgcagcagaacaaccctgtactatactattggcatgctgatattcttggaagatagcctactgaaatttaaatctgcaatggaacctttcttacaggtttttgttagattggaatcaacacctgaagcattgttccaatcagatgctgtaaaatatgcattcgttgggttgatgcgggaccttcgaggcatagcaatggctactaatagccgtagaacgtatgggttcctttttgattggctttatcctgcacacatgccccttcttttgaaaggaattacacattatgctgatattccagaggtaacaactcctttactgaaattcatggctgaactggtgctgaacaaatcccagcgcttgaattttgattcttcttctcctaatgggatactacttttccgagaagttagtaaattgattgttgcttatggatcaagaattttgcctcttcctaataaagcagacttgtacacatccaaatacaagggaatatcaatttgtttgataattcttacaagagcactatccgggaactttgtcaactttggcatttttgaactttatggtgatagagcacttgttgacgctcttgatatcactgtaaagatcatattatcaattcctttggctgatatttttgcatttcggaaggtcgcagcagcttactttgcattcttggagtctctcttcagttgtcatttgtcatttgtcttgagtttggataaaactacatttatgcttgttgttggatctctcgaatctggccttaaagatagcgagaaaatatcatcacagtgtgcctctgctattgacaacttggctacattttatttcacccatgttactgttggagagtcagttacctcacctgctgctcttaatttagctggactcctttctgattgtgctgagcttttctctagaatattgagaaccctatttgaagttgttatatttgagaaccgtggcaatcattggactcttagccgagccattttgagcatgatactaatcagtgaagagatgttcacaaatgtcaaggctcaaattttggtttcgtatccaccagacctacaccagcggttttctttgtgctttaccaagcttatgacagatgtgatgctcagcttggatttaaagaacagggaaaaattctctcagaatctgatcagattcaagtctgagttttgtgccaaataactggcagaatggttttagccagcccagaaacaatatcatatctgctgcttttctctttataatatttaggttcttgtacattgtttaccatgattcgttttgttcttttgggaaggggattggatttttttcttttatcagtggtggggattttttttatgaaaggtctgctggcatttattggcatacctaactagaaaaaagcagggagagaatatagcaattcctatttgaacaggtatttttagatgaatgaggctcagatgccctggatgaaaccattaatctttccccatttaaactagctgaaaaattgttaaattggaaggggatttgtaaattgtagctactctattcagattcccagagcttacaatatatgatattatctgttaacacttt

SEQ ID NO: 159 - DNA, 2000 bp, Glycine max
  misc_feature (1)..(2000): Glyma.06g322700.1
ataaaaactgtctttcttccttcttcgctgaaccctccctccctctccgacatggctgtgtgaatgtgatgaatcttatggtttataaaagtggtccacgctaatcttcgtccagtttaaattattaaattttgaataaactgttgttatggaaaccaaatccaaaaagaatatcaatatattatcattcattgccagctaccaatacactgtatataaataaattttcaaagtaaaaccaaaagcagaaaacattgcatgttaagattcacccacattacacggtttgtgttgtgttgtgcctgccctgtccgtggcattttcgtctttctctaatttcttcttctttctttctctcacttctcttttgaatcaatctcatctcatccctaacaaccacacatgcacgcaccaccatcagatgttgttctgagataatccagataccctttaaggttttttacttcatagctgcagaattccttgcactttgcttggtttttgtctctttccttgagggttatcggattcttcctttgccaaatcttgactgctatgttcttcagttgggatgaaacatgatgaagacttcggctcgattttacaataaagggatattggtattcagtgaagtgaagttaacatttgagatacagaacaagagaaaagcaaatttgatgtaactttttctgattttttggcctggtattgtagaggagtttggttgaaatctgatcagggttattgtttactgattttcgatggattcaattcaaaataaagtttattactgctgtgtttctaagggtaacaatgtcatgtatgtgtatagtggtggagaccaagaagatgagaatgtcgcagccttgtgcttggagagggctcctcctttccacaggtggtattttgagacaataggtaaaaggacttttggtttttttatggaagatgggtatgtttacttcacaattgttgataaaggttttggtaacccggttgttcttcagtttctggagcatgttagagacgagtttaaaaagctgtctagaaaaggttcaagaggaattttgccaaacatgaattcaatttacattcaggaaaaactggttcctgtcatccgcggcctgatcacttcattggagagtgtttcacatggtagtagtaattggagagatgaaacttccttgtcttttcaagtggatctgtctccgtcaccaagtaatttgaatggacaaattgaaggtgctagttcaacaaaagccccgttattgggaaaatctaacaagccagataagaagaaagtaaaagatcatgtgattgctatgagagacgttgagttggaggagcatcggaaatctacagatagaggagcaagggtcgattcaggcaatctggatggtgtaagccaaggtggtgcaggtgcatcagtctctttgcaaaaggatatgggttcaatgaggatgagatcagcccctcaaaacattcgtaagaaatggtggcgccaagtacgcattgtcctagctattgatgcagctgtgtgtatattattatttatcatctggttagtaatatgtcgtggtatatcctgcattcgatagaattcaaacttcttgtgtgactctgaatttgaatcactatcatattggaacttgagattttccatgcatggtctgatctgatcagcaacagaaattagtttcttcgatggggcatgtagattgaagttacaaaccggtcatgttgattagatctttagtgctatttgcaggcacgtgcttcttgtcacccatatataggcattttactttataaagtctactgtacagtttcattactcttagacatctgtacttgtatatgaattttgggaagattttaaaggttcttgattcacctgtttctatagttttttttaagtagataattattttctaatatagagatgaccaatattctcaaatctcaagttgtatatgcagaataattatgccaccgaaatt

SEQ ID NO: 160 - DNA, 1873 bp, Glycine max
  misc_feature (1)..(1873): Glyma.17g253700.1
aaaatacaaaaaacagaaaagaaacaagtttttatccttccttaaggttaagatttgggtggcatattttcaagtggttgagaaaaattatacagcgggagtgttgtgatttctaaatctgagattctgaatctgaagctacgatgagaagttgaagttgaagaagcaaaatggtgaagcattcgcaagcgtggttgttgtgatttctaaatctgagattctgaatctgaagctacgatgagaagttgaagttgaagaagcaaaatggtgaagcattcgcaagcgtggttggcaatgcggagcaagacttgtgcgctaacactcctggcactcttgtccctctccaccctcaccctcctcttcctccgaaccacttccgattcctgcacccaacctcaggttcggaatttggatgcgcttcagcctcggactgattccaagttaccgaaccctctggaattcatgaagtcgaagctcgttctcatggtctcgcacgaactctccctctccggaggacctctcttgctcatggaactagcgtttctgctacgctccgccggatccgacgtcgtttggatcaccaatcagaaacctcctaaacccgacgatgtcatctacactttagaaaacaaaatgctcgacagaggagtgcaggtggtggatgcgagaggtgaaaaggctgtggatacagctcgtaatgcagacttggtgattttgaatactgctgtggctgggaagtggcttgatgctgttctcaaagaaaaagttttggaggttcttccaaaggttttgtggtggattcatgaaatgcgagggcattatttcaaagtggagtatgttaagcacctcccttttgttgcaggtgccatgatcgattcgcatacgactgctgaatactggaagaataggactagggagcgtttagggattaaaatgcctgaaacctatgttgtacatcttggaaatagcaaggagcttatggaggttgcggaagatagcgtggccaagagggttcttcgagagcatgttcggcaatctcttggagtgaggaatgatgatctactttttgccatcataaatagtgtttcacgtggtaaagggcaggatctatttcttcggtccttttatgaaagtttgatgctcatccaggagaagaaactgcaagttccatctttgcatgctatagttgtagggagtgacatgaatgctcagacaaagtttgaaacggaattgcgtcagtttgtcatggagaaaaaaatccaggaccgtgttcactttgttaacaaaaccctggcagtggctccttatctggcttctattgatgttcttgttcagaattctcaggctaggggagaatgttttgggaggataaccattgaagcaatggcatttcgcctgcctgtacttggaactgcagctgggggcacagtggagattgtggtgaataggacaactggtttactgcaccccgttggaaaagaaggtgtgacacctcttgcaaaaaacattgtgaatttggcaactcatgttgagaggaggctaactatgggaaagaaaggatatgagagagtgaaggagaggtttctggagccacacatggcacagagaatcgcattggttctgaaggaagtgttacggaagggtagccacaattaaaattaaccagcttaggcatttcgctgttttgaaattgtaaattctacagggcaaacataatgttttggtgagagtgaattgtataccaccatatcttatgtcatatgtaccgtatgctgtaagcaattggttgatatataggattttgatatgattatttttgaatttgagttaactaaaatgagtcatttcagtgataaaattaaccgttaatatt

SEQ ID NO: 161 - DNA, 1495 bp, Glycine max
  misc_feature (1)..(1495): Glyma.10g058500.1
ataaatatcacagtgcacacccactctgaaatcctctccttttttcataaaccctacttctacttcccccctttgctctcaaaccttatcacctaatccttatcctcccaaaccagaaaaccatgtctacctccgcagcttccctcgcactcccaaccctcactctccgaacccgacaacctctatgttctccccaatgcttctcctcgtccctctccctcacacccaacaacaaacccatttccatttctgctgtttttctcaaaccaacaactctgtcgtcgtctcgcttcgttccccacgtcgtggtgtcgtcggatttggggcaggaggaggacaccttcagtgacggagacggccccagcttctcccccgaccttaagctctttgtcgggaatcttccgttcaacgtcgacagcgcgcagctcgcggagctctttgagagtgccgggaatgtggaggtggttgaggtgatttatgataagactactgggaggagcagggggtttgggtttgtcaccatgtcttcggttgaggaagctgaagcggctgctcagcagttcaatggctatgaacttgatggaagagcattgagagtgaattctgggccacctcctgctcggaatgagagtgctcctcgttttagaggtggttcttctttcggttccagaggtggtggtccttcagatagtgaaaaccgtgttcatgtaagtaatcttgcttggggtgttgacaatgtagcacttaagtcattgtttcgtgaacaagggaatgtcttggaagctagggtaatctatgacagggaaagtggacgatcaagaggctttggatttgtgactttcagtagccctgatgaggtcaacagtgcaattcagtccttaaatggcgtggacttgaatggcagagctatacgagtctcattagcagattccaagcccaagcagttctgaggatttagcttttcgtctatacccgagagaggatttcggtatttgggacttgggagttatacagctgcaagatgtcattggcaaaaacagtttgggaaagaaatacacttacatgcattgagactacatgtacacagtttcaatatctgacaggcttcttcctagatgagtgtctgttgaaagtttaaatgtatgttccaaatttgatggttgtcatttgaaactgatttgtagtccgtattttcactatagaagtagatgtctcaaatttattggttaccccgttccaatattgttgtggaagaattttataatcgtgatgtgcctggaaaattatctaccacggatttatctgttggttcaattgtttgctggggagagcttctgttgaggacttgaggtaaatgaccaagaatttggttctcgttgtggtatcgtcacaatttggttagggatttcctattcaagacatatcatgagagatctgaactgtataatcaaacaacatacagttaaaatttaatatttaatgtcatgtgattact

SEQ ID NO: 162 - DNA, 1271 bp, Glycine max
  misc_feature (1)..(1271): Glyma.11g152600.1
gcaggggttttgctccaaccttacttttccgtctcttgttttttctttccttccttctctcatcttcccagccgccgcttcatactgtcttcactccgttgcctgtgtttttctttcttcctttatttctattcaacggatcggaacggtgcactgtgaaagggtttttgttttgtgagtgtattaaaaaatgctgcgtagaaacatccgtttgaggagagagtatttgtaccgaaagagcttagaaggcaaagaacgcttgctctacgaaaagaagcgcaaaatcagagaagctcttcaagaagggaaacccatacccactgaactcagaaacgaggaagctgctcttcgccgcgaaatcgacctcgaagatgaaaacaccgctgttccgagaacgcacattgacgatgagtatgcttatgctgcggaaaaggatcctaaaattttgctgactacttccagggatccgagtgctcctcttcaacagtttgttaaggagttgagttttgtgtttcccaatgcacagaggatgaatcgcggtggtcaggttatctcagagattatagaatcttgtcgtgcacatgactatacagatgttgttttggtccatgaacatcgtggtgtaccagacggtttaattgtttgccatctaccatttggtccaactgcatattttggattactcaacgtggttacaaggcatgaaattaaagacaagaaagccattggaacaatgcctgaggcttatccacatctgattctcgataatttctcaactaagttaggtgacagaaccgcaaacattctgaagcatctttttccagtgccaaaaccagacacaaaacgtattgtcaccttttccaaccagtctgactatatctcattcaggcatcatatttatgaaaagcatgggggccctaaatctatagaactgaaggaaattggtccccggtttgagttacggctttatcagataaagttgggaacggtggatcaagctgaagctcaaatagaatgggtcatcagaccttacatgaacaccaccaaaaagcggaaatttctcagtaattgatgcaagcatagtgtttgtgcagctaaaccatatgattatacattttgagctcgcatttcactgactgtactttaaggatgtattaagttgattaggttgataaacaagctttttttttttttttaatgaaaacactgtcttttgacagagcaaagttttgagcaaatgaaaatgaaaatgtacttgcttttggatgaaa

SEQ ID NO: 163 - DNA, 2730 bp, Glycine max
  misc_feature (1)..(2730): Glyma.17g157100.1
tatataacgatataataatataaattttgtgtttcagatccgttgttgatttcactataaataagttagagatgcctgatattgccatttgccagtttttcagtgacaaattattgttaaatctgctttccattcctgttgcagggaagggatcagatccagtgagaaaaaaactccaaaacacaagtcttttgtgatcccttattcattctcaagtatagaggaagagcatgctacgcaactgcttcttgtaagcactgtttcaccccagaaaagaaggacacttttttgttgaatactgagtatctcagtttgcttcgggttatattggaaagaagtaaaattttggatagtgaggaatttccagaatgttcaggttatctcccagaaggagtcaaagatccaaaggcttcaaggtgaagcatgctctacagttatgtgttctgcttggagtttgtatctggctggtttaccaactcaaacactctaaggagaagaaatcatcctatgtagaaagcacaaaaactaccagtgaggttgtcaagttcgggaggaaggacctccatcctcgcgtggaggaaacttccgtggtagatgcaaggcacaaggaagaggatgaggaagaagaacaagaagaaaataagcaagaagagcaacacaaactcgacgatgttagcggtgtgcaagatgaggtactaaagcatgagcaaaatgacaatgaagagaattctgagcataaacaggattcggtagaccaagaaactgaagaaaattctgaaaatgcattgacacaagtggaaggagaacagcataatgagaaattgggtgaagagaatgacaatatagacaacaaagagagtgagagtacattgaaggagaatgaggagaacaaaagtgaagggaaggacaaagaaactggagagaatacagaagaaaagactgagcaggagaatgacagtatggataacaaggagagtgacaatacagtgaaggagaatgaagagaataaagataaggagaatgaaactgaagggaagaacaatggggaggaaaatcatgagcaagatagtaaagaaatgacagatgagagcaatcaaagagaagctgagaaagaagaacatggcaagattcaggaagagacttcatctgagaatcaggctcaggatggggggaaaattgaggaagagcatcgagaggaaaattatgcaggagataatgcctctagtgctgtagacaataaatcacaagacgacacctcggatgaaagttccaagacagaagaagaatctgacaaaaaggaaaagaatgagtttgagtctcagaaaaatggtactgaaactacagaagtggctgattctactgtcacaacaacaaacagccaaggaaatgaaaatcagacacagtcagagaatgattcacagaaaagtgttacatcggagtcaaaatggcagcagcaagagcagaataaccccacaaaggtagaggaatccggtgtagaaactcatacaactgaagcattggaaaatgaagataactccaaggtagaggactccaatgcgcggagtacgacacaaaaaactgaagattcttcttctaactcagatgcctcggaagagaaggctgagacacatgacagcaatgcaacgaacggtgaagacaagaacaaggacacctcgactaattctgctcaggacgaaaacaccagcaacaattatgtccaagaaggaaatgttgcgtcatccaacaatgacaataaagattctagccaagatgttcaactcacttcctctgatacttcctcagaacaaaagaaagatgaatccttgaatctagaaagtaacactgactctgctcagaatgacaatgaaaactctgatcaaagcaacaaaaacagtgatggaagtgctaatgacaataaagatgctagccagtcctatacttcatccgagcaaaacaaagaaggatcctcaaactcagataacaatgctagccaatcagatacttcatctgatcaaaacaacaaagagggatcctcaaactcagataacaatgctagccagtcagatacttcatctgatcaaaacaacaaagagggatcctcaaactcggataacagcagtgatgctaaccagaatggctctaacagcaatgaaaatgcaaatgacaatgggaatgctagtcatgaagcacaaaacaatgctgatgcgggacagggcaacaatgaggccactgttgagagtaagacaagtgaaaatgaaggtggtgctcaaaacgaaacagtggagtcacaaaaagaggaggaatctgcacactccggcggagatagcaattctaacttgaatgatcaaggaagttctgatcattcaatcactcaggaggataaagaatctcgcgtggatttgggaactctaccacaatccaatgcagaaaacaataacattgaggttactgctgctgagtgataattcagatagagtaattgtatcaagcttcttttgatcctacttctttttttctatttttgttgtgccatgtattgtttctttagttggatattatgctatcaagttttttgctttacacagggtcagattaagaatttagaaagacctagagttctatttgtataaatcatttgctattattcatatgtaacctgaacccttttatgtaagcaataattatgacgtctaaaatatcatcaaagcaaagttccttctcttttagtat

SEQ ID NO: 164 - DNA, 3353 bp, Glycine max
  misc_feature (1)..(3353): Glyma.09g155200.1
ccgatagttaaatctattgcatctacatctacatacatgcacatccaacaataaatggccactgaaaatgaacgacgaggagaagaaaattgacaaataatactaacaaatctcttttgcaacggttggccatggtaaacaccattggtggttttttctgctatcaatactccatttatagaaaccaaaccagaaaatgtagctaatggctgcaaacaaacacgagagaaagtatagagaagaaggccttgagagaacgagaaataacattgacaatttggattacacatcacatggtcaaagtgtcaaaaaatagagaaaaaaaaaaatcacactttatcgcacaatcacccactacattacacttcctcaaatcacagatagagagagagagacacacacatacgtgtgccatgttgtttgtgttagcagttttctttccttcgccgataaacactccttagctctatcttgttgctcaatcctctcccctccaatccaatttctctctctctctctctcttccccttttcttttcccctgcataaattccacgcacacccacttcccaatccgcgcacacagatccaaagttcttctctttttcacctttccacgctaattccccatctgggtcatccaaattcacaacattactttgctaatcaacccaaccctaattctctgtttttaatcccaattttcatccctttggttttcctgatcagaatcttccacccatgtcgcgagtcttcggtagatggaagaatgcgaaggaaatggcgttgctttcggggtccctgccacgtgggcaccatcgaaccgggttcaatttttgcccaatttcgacccacctgaacatgatcgccggccaccggtggcgggaggctccggtgggggttcaggagcggtacaagtgggaccgcggcgggtcggacgatacctcgtcccggaagatccgggccgaggcgaattgcccacgttgcaccaaagacatgaaccttgttttctccaatcgccactttcccaccccacaaattgaatctgaattgggtggtggagaaagagaaaagggttaccaatcggtgaacctttgcccaagttgcaaaactgcttattactttcgcccttatgacactacacctttgcaaggtacctttgtggagattggtagggtcactagtactaacaataatggtgttaataatgtaagcggtaaggggccttctcctaggaggatcacacatgggaagggtggtggcaaagagggtagtagtagtagtactaataagggggaggaatttgggggcaagagtaatagtaatgcaagtaaatggcttgaagtgtcattgtgggagactttgatggcttacaatggtggtgctggtggaggtgatggtagtaatggcgagccacctgagtcgtggccgctgccaccagatgatggtagtaatgggaatgggaatgggaatggattggctgtgcatactcctccaggcccaccttttgcacctgggattaatgttatccgggctacggggccacggaatggcggatcgggtggtgcaggtgggggcaagggcgagaagactgcctggggagggtctaatttggggaaggattttccctcgcccaaggaaatctgtaagggtctcgacaagtttgttattggccaacagagagccaagaaggtgctctctgtagctgtttataaccactataaaagaatataccatgccactttacagaaagggtcagccgcagattcaggagcttcagaagtattagatgatgacgataatgtggaactagaaaagagtaatgttctcttgatgggtccaacagggtcagggaagacattacttgctaaaacactagctcgatttgtgaatgtgccgtttgtcattgctgatgcaacaaccttaacacaggctggttatgttggagaagatgtcgaatcaatactgtataaactacttgtggcagcagatttcaatgttgcagcagctcaacaaggaataatttacattgatgaagttgacaaaataactaagaaggccgagagcttaaatatcagtcgggatgtttctggtgagggtgttcagcaggcattattgaaaatgctggaaggaactatagtaaatgttcctgagaaaggagctaggaagaatccacggggggataacattcagatggacacaaaaaatattctttttatatgtggtggagcatttattgatcttgaaaaaaccatttcggagagacgacaagattcttctattggttttggagccccagttcgtgcaaatatgagagctgttggaataacagattctgcagtaacatcatctttacttgagtcagtggaaagcgctgatcttattgcatatggcctcataccagagtttattggacgattccccattttagtcagcttgtcagctttaactgaagaccaacttacgatggtcctcactgaaccaaaaaatgctcttggcaagcagtacaagaaattatttagcatgaacaatgttaagttacacttcacagagaatgctctaaggctgatagcaaaaaaagcgatggccaaaaatactggtgccaggggtttaagagccctactggaaagcattttaaccgaagccatgtttgagattcctgatattaagacaggaagtgaccgagttgatgcagttgtaatcgatgaagagtcagtaggatcactaactgcccctggatgtggagggaaaattcttcatggagatggtgctttaaagcagtacctcgctaagatgaaggattcagcggtgaatgtagacgtaggtgaatcagatttacaagagggggatttggagctttcatcaagagccattagcttgtgatattactacatctaccatattcgggatggctggattgtgcaacacgtgtgaagatatcatccctcagaatccaacgtacctttctctctctgccgctttcattttccttctactgcgcactcctccgcccttcaccacgacgccgccgggtcagcttagggacttcttctcatcgccattgtcgaggttttcatactctctttttttctcttcttccatctcccttgaaaatcctttctcatttcctcgagaaactttccagatccaaatgtaacccgtagttaatcaatatcagtgtcactgaccacaaatgcggtgttgatctgaagcttagacaattaatttttaattcactttactttcttatgattattttgtctcattcattcaatttatgaatattcgttgatgctgcaattttttcctcacaaatgatggtttggatttggaaccctgcataacattacgatg

SEQ ID NO: 165 - DNA, 1158 bp, Glycine max
  misc_feature (1)..(1158): Glyma.02g138900.1
gtctgacgaagggagaaggaggcagaggtacaggagagaaggtaggtaggtataccgttgaggggtgcaagaagcaatggcccgcatgttaaactcgggggcccatatagaaagatgtggtttctgcgtctgcgaatgagaaagaggacgataaaggtggaaccaaacaaacaaacaaaacgaacgaagacagcgaaggagctacgctgcgagatttagaaattgaatccctaatttcgaggttccgactcctgtggagtgatcatatagcgaattttgtgttagcgaatcaatttgcagagtaaggaataaggatgggaaaaaaccaagcctacaaagctatgcagagagccaggctcggcggcgcctccgccggccccgacgaggttgaagacggcatggtggatggttcatttcattcaccagaatggcatgcagctcgtttggctagccttaacacctctcacaccattacctgggaggagtacaaaatgaagcaaaaggaagaagaattgagaaaaggggaattggaagcagatgcagataggatgatgagagagtacagagctcaactagatgctgaaagggctcgtaagctttcccaaggaagaaatcactctaatagtaagtctaaacatgtgaaagataagagggacaaaatttcaaagaagcacagcagcagaaagagaaagcattcaagaagatcttctgcatctagctcctcttcgtcatcctcagactcttccagtagcgatgaagaagaaagagggtcaagaagatccaagtccaggtccaagagatcaaagaaggaaaagaagtccaagtcaagaagcaaggatgctggaagcgctagtgaagacgagggtccagttcgcctttcaagattctttgggaacgtcaagagtgaatagtgcttgaatacttggttgtgtatcataaaaaaatcattttatgcaaatagtaaattatggcaagctttacttctatgatcaacgtattctttctttacagatttgtaattttgtatgtcattttgtattctcttctctttcaaaaagattattttgtctttgattaatatgtgtgagatggaggcgcttttgggttttgacgtctataaagtaaatagactggctgtgtacgcactctaggaaaaaa

SEQ ID NO: 166 - DNA, 1409 bp, Glycine max
  misc_feature (1)..(1409): Glyma.20g241600.1
ctttataaaccatcttacttcttcatcctcttcaacaaattaaaacaaaacagtctccatttgacacagtcctagtggtgtactacttattatggccacaccagcatccatcactaatgtcactgtggagttccttcaattccccgcactggtgacacctcctggctctaccaaatcctatttccttggcggcgcaggggtgagagggttgaatattcaagaagaatttgtgaagttcacgggaataggtgtttatttggaagacaaggccgtgtcatcactcgctgccaaatggaagggcaagagtgcagctgaattgctcgactcccttgacttctacagagatatcatcaaaggcccctttgagaagttaattcgagggtcaaagttaagaacattggatggtcgtgaatacgtaaggaaggtatcagagaactgtgtggcacatatgcaatctgttgggacttacagtgatgaggaggaaaaagctattgaggaatttagaaatgctttcaaggatcaaaatttcccaccaggctccactgttttctacaaacaatcacccactggaacattggggcttagtttctcgaaagatgagacaataccagaacatgagcatgcagtgatagacaacaagccactttcggaggcagtgctggagactatgatcggagagattcctgtttcccctgctttgaaagagagtttggctacaaggtttcatcagttcttcaaagagttagaggccaatcccaacattgaaaactgagagttgcagcagttgccaactatctttagaagaccttggaaacaagaagaagaacagcaaaaatttgaagagacatctaaataatgtaacccccccctccccgcagttatgtgtgcactttggtggatttgtaccccatttaataaacgagcaaaccagttattgctaatcattttagtgtgcgttacttatcaaaataagagaagatgtttgcataaaaaaaaattaaaattaagatgatcgtatttaaatataagctgtagccatttcaattagagggtcaaaacttactcatttttccattcccaatcctactgatcagattagcatctaaataattccaaccactggagatgcatttccaaaagtttgaagcattgtgttttggagagacaattggtttaccagaggaatcacacttatatttggatttgatgatggtctagagattaagtttcaggcagccttcgtaagcatggcaaaattggtatctctagcttttcttttcaatcctagaccaccagcacacttgatcccatgagagtgggtgcaggtagtgttttaccattaggttgatccacccaaagaaaagaggggcactgtttatccaaataatcacaaagagcctttggaatat

SEQ ID NO: 167 - DNA, 3137 bp, Glycine max
  misc_feature (1)..(3137): Glyma.13g259200.1
ttggacaaaacaagaggaaaatgttaaaaaactgggaaagatttttgaattgtggagaaactgacaaaaagacaagagctcttgtgtaagatacacaagttagatttccaagatggcaatgctctcataataatattagaagacattaattattgtgaagaagaatcatttttcccaaaatgacccttttgttttgtttctgtactcttcctccccccaaagagtttgaaagttgcacactcataaataagccaccacctagatagtgtcacagttcataacagctttaattcaaactttcaaaaccccatttttatttttttttctttatctctttctttcttgtgtgcctttctagcgtcttggacttcctggttttctgcttctttctgggtctttgttgagagatttttctctcttcccattagtgatgagatgctttgagatccttcaacagtgttagctgattgacaccattgttctctcttctcgtgcaaaatagtgtcatcaaaggctctcatcattgctaagctactgattcaaaaaagaagtccatgaataacaaactacattagactacaaatcagaagccaaggtaaaaaaaagcactgatatgactactatttgaggtgtaccctctgtcaacaccattatatacccacttgaatatgtggtgggcctagtgcaattaatgaggaagtgaaaatagtgtttacttctttgctaggaatatcaggttgcttatatatatatatgggtcacataaaaattcttttttgcctttcttggggtgattgttttgtattgtctctatgagttttaaactgtggaccattgttttgtattaggttgcatttactccgtttgtgtaaaacatgcaacatttacagcccttacatgcttttaaacaaagcaaaaagcaccgaataaagtaggttctgactctgcatgctttcttgctcttgggggtggtattaaaggcatacttttatagcatgtcattgtttgaacacaggaccagtgtgcgatgtggggctgctgctttattcatctttttttatttttatttatctcttattgatttttcggaaagggtcttctaccttcctagtttctagtggaagataaattttggtgtcttgggtttaaatcaattgccttttagttaaatagtcacggttgtagtgagttggctcctttatgataatgtgggctcaagacttccaaggtcataaatgtacatggccattgtgaatttctttctccctctatatctcctcttacctaattatggtttgaaggaggttgaggctggatgtgggaatataaaagcctaactgccatttacttgaaactactccatttgcttcttatagtgcttgtagagagggatagtgaaatgttgaagaatgttttctcattgtcatttctctactgttaataaaagttggcaagtgctaaattgctaaaaaggttccatgctcctactcctcaccccttttgttataaatggtgcattgtttatcttgttgtaccatttattctatctatataagtaggctatgctccttcttttataaatataattatgtatactgcttttcatgtttctagattggatggggctcacttgttcatacagtttattcatttgaacttgcatttttgttagcaggtgagacttttttagccaacaaatccttcacagtatttcatcgtttgctatcttcaagcatatcaaatgccaagatcaagggggtcagagttgcctcaaaggcagtctccacgaggtgcacatcaacatcggacatcaagttctgactctgatccattgcatcatcggccgattgctgaccgaagtccaaagctaggagatcggcgttcccccagaggtactcaatctgagggattaaatcagaagaagctaggaactcgcattgcagatttggaatctcagcttggtcaagcacaagtagagttgaaagttttaaaggaccagctagcttctgctgaagccgcaaagaaagaagctcaagatgagctagtgaagaaagctgtgcaatcagtagtgccagtggtagagaagctccaagagaaatccacttccaagaatgctccagagactaataaaactgaaagcaaatcccaagatattatacctgatgacaaccaacaagagactgatgtgtttgaagttccaattgagaagttgacaattgaattcagcaaacctgctgatcaatcagaaaaggaaactcaaccatctgaagactctaacgcaccagcaatatcaaagccttctgtggatgaacacgaactaacactaaagaatgacgaaattgcattgttgaaaaccggtttggaagagaaaggaaaggagttagagtccatgactaacgaaaaggagaatctgaagaaccaactgaatgaagcagtttcaaaagtgtctgctgctcaaaccaaggaagaagaaatgaccttgcagttgaaccaactgagagaagagttggaagccagtaaagccaatggagacaagttggatgagaagttgaaatctatggaagcaagaaaggaggggttggagtcagagatgaagaagctaagggtgcaaactgagcaatggagaaaagcagcagatgctgcagcagcagtgcttgctgggggtgtggatatgagtgcaaggattcctgaaaggtgtggctccatggataagcactttggtggcacatttgagacacctgctggtagatacaatggctatgtggggtctcccggtatggctgatgtcttggatgatggttttggaggtggtaagaggaagggttctgggattagaatgtttggtgatttatggaaaaagaagagccaaaagtgatttatggcttatatattcagtgagtgaattagtagtactttaactaaggtcatgttttgatggtagcagaaacttccaaagcagttgcttactgttttgcatctttctggtatctttagtcttttgtggtattattaaggccattaagcgtgtagtgttactgttgcatcatctgtgcaaggtagtgatgtgaactttttgaaagatggattatatatttcacttctcctaaagctgtgatgagcacttttacttgttttta

SEQ ID NO: 168 - DNA, 2042 bp, Glycine max
  misc_feature (1)..(2042): Glyma.13g166100.1
actggccatacatacaccatttccatttatcagtctttggatctcgctctcctttctttccaattctagaatatcctatctttctcatttcaactcttggttcttttctcgtcacgctagtaagcgtagttcggtgttggagaatcaggttccagtcccagaatactgctattctcgaataactgaattgtgtttctaggttatcttctctgaattgcaattgcaaatgaatgatcgttgaaaaactatgaagaaggtgaggagaaagatcggcaagtatgaggtgggtcgaacaattggcgaaggcaccttcgccaaggttaagttcgcaagaaactcggagacaggggatagcgtggctattaaaatcatggctaagaccaccattctccagcacagaatggttgaacagattaaaagagagatatccattatgaagattgtcaggaatcctaatatagttagattacacgaggttttggctagccagaccaggatctacataatccttgaatttgtaatgggaggggaactatatgataaaattgttcagcagggaaagctttctgaaaatgaatctaggcgctactttcaacaacttatagacacagttgatcattgtcatagaaagggtgtgtaccatagagacttgaagcctgaaaatcttcttcttgatgcttacggaaatttgaaggtttctgactttggattgagtgcattgactaaacagggtgttgaccttcttcacaccacttgtgggaccccaaactatgttgcccctgaggtactcagcaatagaggatatgatggtgcagcagctgatgtttggtcatgtggagtcatcctatatgttctaatggctggatatcttccttttgaggaggcagaccttccaacactgtatagaaggataaatgctgcagaatttgtttgcccattctggttttctgcagacacaaagtcattcatacaaaaaattctggatcctaatcctaaaacacgggtgaaaattgaagaaataaggaaagagccatggttcaagaaaaactattttcctgtcaaactcggggaagacgagcaagtgaatttggatgatgttcgagctgtttttgatgatattgaggaccaatatgttgctgaaaggtcagaaattactgagggaggtcctctgataatgaatgcatttgagatgattgccttatcacaagggttgaatctttcaccactatttgataggcttcaggataatgtaaagcggcaaactcgttttgtctcccgtaaaccagcaaaagttataatttcttcaattgaagctgttgcagagtcaatgggtcttaaggtccattctcgcaattacaaggtgaggcttgaaggcgtttctgcaaacagggttggaccatttgctgtggtcttggaggtgtttgaagttgcaccatcccttttcatggttgatgttcggagggccaccggggatacttttgactaccacaagttttacatgaatttttgtgccaaactaggaaacattatttggagaccggcagggactatgccaaattctaatctgctcaagcaaatgactttataatccacttcatgcgggtgtgattaattagaagagcactaactggtccccgagtatgctaaaaattagcatcctttctagctatcataatgcaacatacactgtatgaatagtattgcaaacgggaatcactgtcaacttacaacatggcttaaagtataatggtttacaaaaacaatcttgggagaaggaaaggaaaaaaaccctattgcaatcatcttgtagttgtagcaaatctatcccacaatggtttacaaaaccaatatattgtttggttcgggcagaaatgtataaagcataatgctttccgtcaccaattctgtcagcgtgtttgggagagctattcaaattctcaaacacgtttgtttgagacatgctgttttgtataaaaaagcgtctttggtcgcaataaattaaaagttaagtctgttaattgtcattaaaattgaaaatataa

SEQ ID NO: 169 - DNA, 1198 bp, Glycine max
  misc_feature (1)..(1198): Glyma.02g161100.1
aaaaatctcgataaataaattattttctcttctccaaaattcaactcaataatcccttccctggttcccatcatggacgaattagaagaaaccctactcacccaaatcgactgggaatcgttcctcgacgacatacctgaacttaacgtcgatgattttttgcaggacgacaacgccgttcctgttgttaccgacaatcattcctccccgaacgacgaccccgttttgtccgagatcgagaacatgctcatgacgcaggccgaaaacgacgctgtcgttttgcccgagacgccgtcttcggaggccgggtattacaagctcttcgaggagattctggtggaggagcccaaggaaggacccgtgagcccgccttcaaaaatagagtccgaggaaggctccgacaaagacaagaccgatgatgctgcttccgatgaacccatgtcgaagaaattaaagaggcagttgaggaacagggatgctgctgtgaggtcaagggagaggaagaagttgtatgtgaaaaaccttgagatgaagagtaggtacctagaaggggaatgcagaagactggggcatttgctccagtgctgctatgctgagaacaacgctttgcggctttgcttgcaattgcgtggtacatatggtgcttcaatgaccatgcaggagtctgctgtgctcttgttggaacctctgctgttgggttccctgctgtggtgcatgggcatcatatgccatctcagtctgcctctaatgctgtgggttgcagcagtacttccaagagaaaacatcgagcagaagggcctaagaagggtaactcaaaaaggatcagaaagtaagatctctgagtgtttccagatgcaatcatttttaaagagtagaaaaagccgagcttcaagaacaaagatgaaattcaattttatagtgttctaatgttctataacttctgaagtgggggctctaaggttttctattcatctcttctttctttcgttcgttttctcttttgttttattggatttataaatacggtcgaacttgttagaggttctgtgatatgcttttttaggtgctgttcttgtaacttatattgggaccataacatgttgcgttcttatctttaacatagacgtcgttttgagtttttggcagttcaatgaaacttattgtttgcaccattttggatgcccccctcttttttagt

SEQ ID NO: 170 - DNA, 2008 bp, Glycine max
  misc_feature (1)..(2008): Glyma.19g053500.1
aaaattcctatatgtaatggaatggtcttgagatatgattagtcttcacacagagaagtgaaacaaaatctggaacaggtgtgcatggatagactcaggaagtggtccccactagagctgcaagcaaagacagtggaaacatagaagggatcgccagatttaactttgaaacatagtttctcacgaaactggtgtgccatctccgccccccatcacccttttctttcccttcttatattcactctcttcctcctctcttcagcctctattcttcttcttcttcactgctccaattattattgcattgcattgcattgcctcacttctctttctgttgttgtttcttcatggctccagccttggaagaaggaggagaaagagaaactagtgtggcacagaacaactccttgaacagtgttgtcaatgatgccacacacagatccaaagtcactgttattggaagtggcaactggggcagtgttgcagctaagctcattgcctccaataccctcaggcttagctccttccacgatgaagtgaggatgtgggtatatgaggagacactactaagtggtgagaagctcacagatgtcatcaatcgaaccaatgaaaatgtcaaatatctccctggaatcaagcttggcaaaaatgttgttgcagatccagaccttgaaagtgccgtgaaggattccaacatgttagtgtttgtgactccacatcaatttatggaaggaatatgcaaaaggcttgttgggaaaataagggaagatgctgaagctatttcccttgttaaagggatggaggtcaaaatggaaggcccatgcatgatctctagtctcatttctcagcaactgggaatcaactgttctgttttaatgggtgccaacatagcaaatgagatagctgtggagaagtttagtgaagcaactgttggatacaggctcaatagagaagttgctgagagatgggttcagttgttttatacacactatttcattgtgacagctgttcaggatgttgaaggagtcgaactgtgtggaactttgaaaaatgttgtggccatagcggcaggttttgtggatggcctggagatgggaaataatacaaaagctgcaatcatgagacttggtcttagagaaatgaaggcattttcaaagttgttgtttccatctgttaaggacagcaccttttttgagagctgtggtgtagctgaccttatcacaacatgcttgggtggaagaaataggaaagttgctgaggcttatgcaaggaatggagggaagaggtcttttgatgagcttgaagcagaaatgctacaaggccagaaattgcagggtgtctcaactgcgagtgaggtttatgaggttctaagccatcgtgggtggctagagttgttccctctcttctcaacagtgcatgagataagcactggcctacttccaccatcggccatagttgaatacagtgagaagctacccaggtccttctaattcaaagcatatttgttgtataagaaaatataaattatagtgacagtatcaaggatatacaaaatgcatgctttagctgtatcaacagtggaaagcattggtggctaggctgctttttctttccaaaagatcatgccaacaaggagcttgtttccatatggttgaggttctctgaaggccaaggaagttgactttttgtatgaagttcttatcaagttgtattattccactgcaaacaattaatacatgcagcaagcttacatagtttacatatacaataaagtagtaattgaactgtgtattgatccatatgtttgatttttccatttttcataagctattaattgagctgtgtgttttattccccaatttggatgaggaaaatgctttaggatttaacactacaggttgtatatgttgaaggacattagctgggattatttttcccattttttctcttgactttcattgtccctctttgctctctattaaagtagtgatcatattaattttctaca

SEQ ID NO: 171 - DNA, 5288 bp, Glycine max
  misc_feature (1)..(5288): Glyma.10g106500.1
taaccgttacctctccccgctcgttagcgcgctatctcaacgcaaacccctgatacacccaatttcccgacacaacaacaaattcgaaatacgctgagaagcgcactttaacccaaaatgacacccacccagcgcacattagtattcacccgtgcttcgcacaccggctgcgtctatgatctttctcttctctctcaccgcgacctttcttatccttcgcaccctttctttagggctaaggcttcttctcctctctccctaacctcttcttattcttcttcgctctttcggaaaattagggtttcttcgttcgctgttattttcaaattagcgcatggatcgcaaatccaaacgcaaccactcgttctcctactccactctcttcaacctcgagcctttgaagaactttaaacttccacgtgaagatgatgatgattttgattattatgggaataatagtcaggaagatgagagcagagatagccaaggtgaaagggaaaattactgtaatggaaatgtgcacgcaagggagcagaattcgtcgagtaagagggtgtggtctgagaacagtgatactgatgatgagaataagggaagatattatgggacacacatgacacaggaacgatatcaatcaatgcttggagaccatgttcagaaatacaaaaggaggcgtaaggatgccatgtctaacactgatcaaaatcaggttgttgttcctcttgtcaaaagtaacaatggcttaaaaattcaaaagtcagggaatgattgtaggggagcatcacatgctgaagaaagggcatcggaatggcttcaggatcagaaacaaggaaacttcagtcgtgcagatttcaagcagcaatatggcactgataggattatgtatgaacctgctgttttggacattgggaatggtatctcttatgagattcctccaatttacgataagttggccccgatgctgaaccttccaaacttcctggatatccatgtcgatgaattttacttaaagagtaccttggatttggggtccttggctgcaatgagggctgctgataaaaggtttgggactagaaaccaagcaggaatgggggaacccctatcccaatatgaatcacttcaggcaagaataaaggccatgccagcttctaattcacctcataaattcagcttgaaagtgtctgatgttggattgaatttatccattccggagggtgctgctggaaccataaagcgatctattttatctgagggtggtgtattgcaggtttattatgttaaggttttggaaaagggtgacacatatgagataattgagcgaagcctaccgaagaagcaaaaggtaaggaaagattctgctttgatagagaaggaagaaatggatagaattgggaagatttggataaacattgtaagaagagacatagcaaagcatcataggaatttcactaattttcatcgaaagcaactcattgatgccaagaggttctcagactactgtcaaagagaggttaaaatgaaagttagtagatcactcaaatggattaagggtgctaacattcgcacccggaaactagctagagacatgttgctgctctggaaacgagtagataaagagatggccgaagtcaggaaaagagaggagaaagaagctgctgaagctttgaggcgtgaacaagagcttcgagaagctaagaggcagcagcaaaggcttaattttctcatacaacaaactgagctgtacagccactttatgcagaacaagtcaagtgtacactcttcagatgctttaccctcggtagatgaaaacacaaatgatcaagatgtactgtttgactcttcagacgctgggcataatgaggaggaagatccggaagaggctgaattaaagaaggaagctttgaaggctgctcaagaagcagtctctaaacagagaatgttgactaatgcttttgacagtgcatgcttgaggttccgccaggtggatgaagccgattcacttacacggcaattagcaggaggaagtaacattgatttgcaaaccccatcaaccatgccagtggtatccacagttcagacaccagaattatttaaaggttgtctaaaagaatatcagctgaaaggtcttcagtggctagttaattgttatgagcagggtttaaatggcatacttgctgatgagatgggacttggaaagaccatacaggctatggcatttttagcccatttggctgaggagaaaaacatatggggaccttttctggttgttgcacctgcttctgtattgaataattggaatgaggaacttgaacgcttctgccctgagattaaaagacttccatattggggaggactttcagagcgagcagtgcttaggaaaagtattaacccaaaggatctttatcgtagggaggctaaattccacattcttatcacaagctatcagctattagtaactgatgagaagtattttcgccgtgtgaaatggcagtacatggttttagatgaagcccaggcaatcaaaagttcaaacagtataaggtggaagacacttctcagctttaattgtcggaatcgcctactgctgactggtacacctgttcagaataatatggcagagttgtgggctcttctgcactttatcatgccaactttatttgacagccatgagcagtttaatgagtggttctcgaaaggaattgagaaccatgcagaacatgggggtacgttgaatgagcaccagcttaatagattgcattcaatactaaaacctttcatgctgcgacgtgttaaaaaggatgtaatttctgagctgactaataaaactgaggttatggtgcattgcaagttgagttctcggcagcaagctttctatcaagctattaagaacaagatatctcttgctgggttgtttgatagtaatcgtgggcagctcaatgacaagaaagttatgagtttaatgaatattgttattcaactaaggaaggtttgcaaccatccagagttgtttgaaaggaacgaagggagcacgtacttttactttggagaaattccaaattcccttccacctcctccattcggggagttagagaatatatactatcctggtgggcataacccgatatcatatgagataccaaaacttgtctataaagagattatacaaagttcggctgttggtcatggtatctgcagggaatcttttcagaaatattttaatatttttagacctgaaaatgttcatcgatctatcttctcagaagatattattgttaaaagtggaaactttggttttacccatctgatggatttgtctccccaagaggtggcatttatggccactggttcttttatggagcgactgttattttcaatgatgagatgggaacggaagttccttgatgaagttttagactttcttatagagaccacaatcggtgatcctgaatgttaccttgagaaaggtaaagtgagagctgtttcacgaatgttattgttgccatcaagatatgagaccaagtttcttcagaaaaagtttgcaactggacccaccaatgctccttttgaggccttgatggtctcacatcaggataggctttcatcaaatgcaaggcttcttcactcagcatacacatatatcccaccaactagagctcccccaatttgtgctcactgctcagacagaaacttctcctataaaatgattgaagaattacatgatccttgggttaagaggttgtttgtgggatttgcgcgtacatctgaatgtaatgggcctagaaagcctgataatccttctcatttaattgaagagatcgattctgaattacccatttcacagcctgcacttcagttcacgtatggtatttttggctcttcaccgcctgtgcggaattttgatccagcaaagttgctcactgactctaagaagcttcaaacactggatatattattgaagcgcttacgagcagaaaatcatcgtgttctcttatttgctcagatgactaagatgctgaatattttggaggactatatgaactatagaaaatatagatattttagacttgatgggtcatccactattcaggatcgcagagacatggttagagacttccagcacaggagtgatatttttgtgttcttactgagtacaagagctggtggattgggtatcaacttgacagctgctgacacagtcatattttacgagagtgattggaatccaacattggatctacaggcgatggatagagctcatcgtttgggtcagacaaaagatgttactgtttaccgtcttatatgtaaagagacagttgaagagaagattcttcatagagcaagtcagaaaagtactgtacagaaccttgtcatgactggtggttctgttggtggtgatcttttagctcccgaggatgttgtatctttgcttcttgatgatgttcaattgcaacagaagttaaaggaaattcctctccaggtaaagagtaagcaaaagaaaaaacctaacaaggctatacggataaatgaggaaggtgatgcatctttggaggatctaacaaactgtctagaccagggaactgcaaatcatgatacttccatggatccggagggaccaaagtccagtaataaaaagacaaaaacagcttctgacaagcaaaaaccgagcccaaagtgttctcagaagaagatgaaaggcagtatgtctaatagataacgaataagatgatgcctgtctagatactgattagtgatccagaaacgtagaccaaagaggtcaagagaagaatataaatgaaaagtttgaaaactccacattccagagcggacccattttccacctccacgtgatttcagtctggaggttctaaagcagaaaccattcaacacgccttaagatgtggtggtgacttctcacaatagaataatttactaaatacttggccgtaagtattctatcaaacttgtaaattgacatttatggagagattgctaggttagctctcttattgatcatccagcttatagtttttcttgtctttttggatccattattactgaaatcaagggcaaagctaaggtaagaaactgtataggcccaggttgtatatgttggttatgggtccatccctcttcattagggggcttttgtttagattgggttatcttcgataatgctaatcgttaaggttctgttaccaatatttatagtaattgatgatatctggtggcgctacatgctcatgctcacttttcatgttagaacacggtggagttgtatagggtgcaaa

SEQ ID NO: 172 - DNA, 895 bp, Glycine max
  misc_feature (1)..(895): Glyma.04g132900.1
ctattttttggtgctgtgagtgagacaccgatagatagagagcgcggcataacctaaacctatctttcttctctctctgtgtgtgcgcatcaacggcaaccagaagcagccatggccactgcaaggactgtgaaggatgtttcacctcatgagttcgttaaggcgtactcctctcacctcaagcgatccggcaagatggagctgccagagtggactgatattgtgaaaactgcaagatttaaggagttggctccttatgatcctgactggtactatgtcagagctgcttccatggcaagaaagatctacttgagaggaggacttggtgttggtgcctttcagaggatttatggtgggagcaagaggaatggtagtcgccctcctcatttttgcaagagcagtggtgccattgctcgtcacattcttcaacagttgcagaacatgaacatcattgaactggacaccaagggtggcaggaaaatcacttccagtggccgacgggatcttgaccaagtggctggacgcattgtggttgcaccatgattcatgatttgaaaatgccataagcatattgaggtttttgggttcttgttagagagatgtgataacagattatgctcaaattttgattttagactgagtgtcttttgtgtattagacgtcttttgtgtattagacatgctcaatgtttatgttgctttcagtcattttagataatattgctacatttaatttgagtttttctttggacattcttgttccttaagtgtcttttacgtatgaaatgaaatttaagggtaaattaaactgattacatggtgtatgttttgatgacacaccaaactaccaagttatgccaatttgtgctctctatgtcatattatgttttccaatt

SEQ ID NO: 173 - DNA, 1517 bp, Glycine max
  misc_feature (1)..(1517): Glyma.03g027600.1
tcgaccctcctccttgaagaaacaaatcatcattgatgttaattttgattgagtattattgagttttttttgtgaacataaggagtgagaatttgccaaagaagaagaagaagaaacatggtggaaggttagagagtgagagagtgtgaagcatggaagtgggtatgcttccaatctcagcttcaaagagaggaaaactcttggctgctggttacaccactctcgatgccattgctcgtgcctcccccacccaccttgctcgagatattgatgtttctgagagtgaagccacggaaattctgaatcttgcaagcaaacctagtgctttggagagaccgaatgggtctcacactgctgttgttggtggtggtcagactgcctgggatatgctcaatgatgaaaagttttcttcttacattaccacatcttgtgcagatctggataacatccttggtggaggaattaagtgcaaagaagtcactgaaataggtggagttccaggcattggtaaaacacaaattgggattcaacttgcggtaaatgttcagattccacaagaatatggtggcctaggagggaaggcaatatacatcgacacagaaggaagctttatggttgaacgtgttctacaaattgctgaagcatgcatagaagatatggcagaatacagccggcactttcataaggattttcaagcttgtgatgttaaaatgcaccctaataatatcttggaaaatatattctattttcgtgtttgcagctacactgagcaaattgctttgataaattacttggacaaattcatcacagagaataaagatgtaaagatcctcattgttgacagtgttactttccacttccgccaagactttgatgatatggctctcaggactcgattactcagtgaaatggctttgaagttgatgaagcttgcaaaaaaattccgtttggctgttgttatgttcaatcaagtaacaaccaagcatattgaaggttcatttcaattgacccttgcactaggagatagttggtcgcattcatgcacaaataggataatcttgttttggaatggcaacgaacgacacgcatttatcgacaagtccccttctctgaaatcagcatcagctccatattctgtgacaactagagggatacgcaattctacttcaagctgcaaacgaatcaagatgatgtgagattttgagtaggaagatagtctataactcaaccttacctcaccatttttgcttatttctttaccaaatttatggacataacaagattataccacatgcttcctacaatccttgctttgtgtagcctcaaagtacagtgagttttggtttggtttatatataaagctcatcttaattgagtttgtcttaaagtgaacacatataaggggttattcacccttaaagtacatacatattagagatgtacttactctaaagtttttccttggatttacttgatatttgaaaaaactatacagattacagaataattaacctcac

SEQ ID NO: 174 - DNA, 1838 bp, Glycine max
  misc_feature (1)..(1838): Glyma.13g078800.1
ttttctgcagctaactaccaagcaaacacacagttagctctcgctccctggctgatggatggcggtgatcctaccaaactactcaaagtccatctagtcacctgcaccgactcggccgagttcgcgctcctgagctcggcgctgactcggacctcggtggtgggcctggacgcggagtggaagcccgtccgaagattgttcccgagggtggcggtgctccaaatcgcgtgcggcgactcggcggtgttcttgctcgacttgctgtcccttcccctctcttccctgtgggcccccttgcgcgaattgctgctctcccctgacatcctcaaactcggattcggattcaagcaggatttggtctacttgtcatccactttcgcctcccatggcggtttcgataaggttgagccatatttggatatcaagagtgtctacaatcatctacagcataataagaaacatgtacccaagcaaagtaagagtttgtcaaccatatgtgcagaagtattggggttttcactctccaaggaactccaatgtagcgattggtcacatcgtcctcttacagaagagcagataacatatgcagctatggacgctcattgcttgctagacatatttgaggtcttccaagcaaaggttgtcaaagaaggagacttgattctcgagactacggtattgtctaatcctgatgcaagtcttgggttgaaagaacttttccaaaatcatgatatgagtgataaagtcctaagagcacatttttctgaagcgttagcaattgtccaagccactacttgttcagatactgctcagatgatacctttagcagggggaatgatccaaaaatcatcatgttgggttactgtaccaatggatgaagttttgttgaaagttgtgaaaaaatatagtgataagattttgctaaaggagtcagacagaaagcccaaaagctcaaaaaagaaagggaagaagcattcactatttaatgggattagcctagaaaaacattttgagaagtctgatgagtggcgaggtaccccgccttgggatcctttggtggggggaaatgcatatccaaagttcctttgtgatgtcatggttgaaggcttggccaaacatttacggtgtgttgggatagatgctgcaattccttattcaaagaagcctgaaccaaggatgttgatagaacaagcacaaaaagagaaacgtgtgattttgacgcgggatgcaaagttgcttagacatgattatctgacaaaaaaccaaatatatagagtgaagactcttctaaaaaatgaacagctactcgaggttattgaagcttttcagataaaaattaatgaggatcagctaatgtcaaggtgcacaaaatgcaatggaacatttattcagaagccactgacaactgaagaggctattgaagctgcaaagggctttcaaagaattccaaattgcttatttaacaagaatttagagttttggcagtgcatggactgtcaccaactttattgggagggaacccaataccataatgcagttcagaagttcgttgacatttgcaagctgagtgactaatttgaacttctctgtataatacaaaaaagtcgttttcacttcaatgtatctgttttagtgcaatctatttatgtgatgtagtttatattttgcacatagatttggccatcactgccccactcttggttgttcctgcgtattctactgaatgcgagaagcgattgaaaccagatacgaatcattgaatttcaataaaaaaaacaatgaatcagtttaattgtacattttaccacttcaattaccatcatttcataaattttatc

SEQ ID NO: 175 - DNA, 4887 bp, Glycine max
  misc_feature (1)..(4887): Glyma.06g268700.1
aattattagctttataatattccttcactgcccacagtaattgtcctcgcattccgcttctgcaattgcaatggcttctaacgccatcatccaatacggctcttcttcttcttcttcatctcatgcgatcatcactgcatctgatgtgtttgtcagcttccgcggtgaagacacgctcaacaacttcactgtttttctctttgatgctctctctcaaaatggcatcgatgccttcaaagatgatacacatcttcagaaaggcgaatccatagcacccgaggtgctacaggccattgaagagtctctccttttccttgtggtcttctctaagaactatgcttcctcaactcggtgcttgcgtgaacttgcacacatctgcaactgcaccgatgaagcatccccgagtcgtgttcttccagttttctatgatgttgatccatcagaggtgcggaaacagagtggttattatgggattgcctttgcagaacacgaacgaagattcagagaagatatagagaagatggaggaagtgctgagatggagagaagctctgacacaagtggccaatatctctggctgggatatccgaaataagtcacatcctgcaatgattaaagaaattgttcaaaaaataaaatatatattgggtcccaaatttcaaaattttccaaatggtaatctggttgggatggaatcccgtgttgaagaattagaaaagtgtttagcactggagttggttggtgacgttcgagttgtcagaattagtggaattggtgggataggaaaaacgactcttgcccttgcgtttacagggggtacagatactctattaagtgaatgtcttggtgaagggagcagaatcgttataatttgtaaggatgaacaactattaaggacacatgaagtatatcatgtttaccgagtgcaaccgttgaatcgacacatcgctgttcagttattttgcaaaaatgctttcaaatgtgactatattatgagtgattatgaaacattgacacatgatgtactatcacatgctcaaggccatcccttggcaattgaagtaataagcaaatctttgcattgtcgaaatgtttcgcagtggagaggtagattggttaggctaagtgataaggtaagtaagcatactttgaaggtgttgggaataagaagcttctgcaatccagttagatgtttgtttccttccttttctattttctcatgtatccgtgaacttgatctaagtttctgcaatttacttaaaatccctgatgcttttggaaatttgcattgcttagaaaggataagtttaagtggaaacaattttgaaacactacccagcctcaaggagctttccaaactgttaagattagacttacgacactgcaagagattgaaatatttgcctgagctcccttcacaaactgattggcggccttcggatattcgcctgagctcccttcaagatgatgaatcggatgatgaatcggatcacttgcggctattctattacactcgatcacattttgatgtctctaattttgatgagttgaaagtggaaagtagattcagagatctttatgatcaagatttggatgttgaggtgaagaaatgtgggtatgatcgggtatatgtacgggatttagaaccatcactcaacacaggaatcgggaaaagaaaaaggggatttgattatgaagacttgattaaaggtgtactatcacatgatgtgccatcatcatcttccttcaccaatgatgtgttcctcagcttcagaggagaagatactcgttacagtttcactggcaatctctgcagagcccttcgtgacagtggaattcacaccttcgttgatgacgatgagctccagagaggggacgaaataacgtcagaacttgagaaggaaattgaagactccagatttttcatcatcgttctctctcagaactatgcatcttcctcattttgcttaaacgtacttgcttacattcttgagtgcgttaagagaaaacgtttgttggttttgccaattttttacaaggtggatccttctagtattcgattccatggaggtagttttggagaagcattggctaatcatgaaatgaagttcaaagctaaaatggacgggttggagcataacatggagaaactggagaaatggaagatggctctgcacgaaacagctaacttctcaggctatcatttcaaacaaggggatggatatgaatacgagtttattaccaggatagttgaattggtctctagcaagattaaacagtatcctttccatgttggggattatcgagttggactagagtcatattcagaagcattcaactatgatgtgttcctcagcttcagaggctcagacacactccatggttttactggctatctctacaaagctcttcatgacagaggaatccacactttcattgatgaagatcttaagagaggagaagaaataacaccggaaattgtgaaggcaattgaagagtccaggattgctatcattgtgctctctataaactatgcttcttcctccttttgtttagacgaacttgcaaccatccttgactgccttgagagaaaaagactattggttttaccagtcttttataatgtggatcattatcaggtgctgggaggtagttatgtagaagccttggtgaaacatgggaagagtttaaagcatagcatggagaagttggagaaatgggagatggctctgtatgaagtagctgacttgtccgactttaaaatcaaacatggagctcgatatgaatacgactttattggggagatagttgagtgggtctccagtaagattaatcctgctcattacccggttggattagggtcaaaagtgctggaagtaaggaaacttttggatgttggacgtgatgatggtgtccacatgttagggatccatggaattgatggtgtagggaaatcaacacttgcacgagaagtttataataaactgatttctgaccattttgatgcttcctgttttattgaaaacgtgagagaaaaatctaaaaaacatgggttacatcacctccaaaacatccttctttcgaaaatacttggagagaaggacatcaacctcacaagtgcccaacaagagatttcaatgatgcaacggcataggctccagcaaaagaaggttctcatggttctagatgatgttgacaggcctgagcaattgcaagcagttactggaaaacctgcttggtttggtcctggcagcaaagtcataatcacaacacaagacaaacaactgctaacatcttatgacattaatagaacatatgaggtgaagaaattgaataaggatgatgctcttcaattacttaaatggaaagcttttaagatgcattacttcgatccaaggtataagatgctcttaaatcgtgcagtaacttttgcttctagtcttccattgactttggaaatattagcttcctacctatttggaaaaagtgtaaaagaatggaaatttactttccaccaatttgtaagaagtccgaataatccaatggaaatgatacttaaagtaatctttgattctttgaaggaaaaagaaaagagtgttctacttgacattgcttgttatttcaaaggatatgaattgacagaggttcaagatatacttcatgctcattatggtcagtgcatgaagtattatattgacgttttggttgacaaatctctagtatacattactcatggtacagagccttgtaacgatacaattacaatgcatgaattgattgctaaagagattgtccgactggaatcaatgatgacaaagccaggtgagtgcaggagattatggtcatgggaagatgtaagggaagtttttttaggatacaagacggcaactagcaaaattgaaattatatgtctggattaccccatatttgatgaagaagaaatagtacaatgggatggaacaactttccaaaatatgcaaaacctcaaaacacttattattagaaatggtaatttttccaaaggtccggaatatcttccaaatagtttgagagtatttgaatggtggggatatccgtcacattgtttaccatctgattttcatccaaaggaacttgccatatgcaagttaccctgcagtcgtatttctacaactgagttgaccaacttattgacgaagttcgtgaatgtgaagcgtttgaaattttcaagcgaaaaggtaagcttaaaatattgagtgcttttggttgcatcaagcttagaagttttccaaccatcaagttttccaaaaatatcagaaaagatggaaaatgtaagggaacttcatttgcagtacactcccataagcatgtctgtctagttgtggagttgttcagttaccaagtagcactgtcatgttaccagaactgactgatattatagcttttggatggaaagggtagcaatggctaaaacaggaagatggtgaagaaaaagcgggttcaatagtatcttcaaagaatttcagtttttaaagatgcgacttgttgcgagcatcttttggaaattagagggagtcaatcatactgaaaacatttcttggcaagaggatctgcacgaggccggaaacactatcattttccaggagtaatatatagtggttcaatcaccaaagcaaagggaccttcaagttctttttggttttgtatcacctgacaaagttctttttcttcttattgcacctatggataatggatctggatttttttcatcccatgttcatcaatggcaataaatgttcccttcattgtgtcatgttcttgatgggatgggatcatacgtatcttctaatctacatgtgtatgaggtgctttttgaaaatgaatggaactatttggaagttgcatgtgc

SEQ ID NO: 176 - DNA, 939 bp, Glycine max
  misc_feature (1)..(939): Glyma.02g095000.1
acaagttctttgggtttcaaatcttgggcccgacaaggttgttcctgtaatttcgtgttctatataaatcacctccctccttcagctgcttaacctaaaaccctaattctacagcagccctccgatttttaaggaggttgtgtgaattgctggtgagtgatttaaatggctcctactaaggtggacaatgccaaaagggctgatcccaaagctcaggccttgaagacagctaaggctgtcaaatcaagtggtcaagtgtttaggaagaaagctaaaaagatcaggacatcggttacatttcacaggccaaggaccttgaagaaggaaaggaaccctaagtaccctcgcattagtgctccacccagaaacaagttggaccattatcagatacttaaatttcctctaactactgagtctgctatgaagaaaattgaggataacaacacgctggtttttattgttgaccttcgtgcaaacaagaaaaagattaaggatgctgtgaagaagatgtatgacattcaggcaaagaaagtcaatacattaatcaggccggatgggacaaagaaagcctatgttaggttgactccagattatgatgccttggatgtagctaacaagattggtatcatctaagttgtactcttgattttagcgaagctaatccttcattgttaagatagttgttctacatgttctgagttaggactctttgttttccatatgtattgactattgttcattcaattttgagttgagaacatgaattcagttttatactagtataattaatagtataaaagtagtttactgactccattgtttccaaggtttgatcaatgtccatttccttatatgccaaggtataaatttatgtcccaaacacctgcataattaagttttcttcttcacttggtatgtgttgtaatgttggtagtggat

SEQ ID NO: 177 - DNA, 2015 bp, Glycine max
  misc_feature (1)..(2015): Glyma.13g345000.1
aaggatttatcttctttttatctgatgagcttgggcgtgtggaatggaggtgagaagcatgtgggaagctctgcaagtccacgggcaagtagtgaaattagggatggggcacaaggatgcgtcgcgtaagttgtctaaggtcttcaccttcgccgctctctccccctttggcgacctcaactacgctcgtcttcttctctccaccaatcccactctcaactcttactactacaacaccctccttcgcgccttctcccaaacccccctccccacccctcccttccacgccctctcccttttcctctccatgccctccccacccgataacttcactttccctttcctcctcaaatgctgctctcgttccaaactccctcctcttggtaaacagctccacgctctcctcaccaaactcggcttcgccccggatctttatatccagaacgtcctccttcatatgtactccgagttcggcgacttgctcctggctcgctccctgtttgatagaatgcctcacagagacgttgtttcctggacctccatgattggcggccttgttaatcatgacttacccgttgaggccatcaatttgtttgagagaatgctgcaatgtggtgtagaggtgaatgaggccacggttatttctgttttgagagcctgtgctgattctggagccttgagtatggggaggaaggtccatgctaatttagaggaatggggaattgaaattcactctaagtccaacgtttccactgctcttgttgatatgtatgccaagggtgggtgcatagcgagtgcgaggaaggtgtttgatgatgttgtccacagagatgttttcgtttggactgcaatgatttctggcctcgccagccacgggctttgcaaggatgccattgacatgtttgttgacatggaaagttctggggtaaaacccgatgagaggacagtgaccgcggttttaacagcgtgcaggaatgcaggcttgattcgcgaaggtttcatgttgttcagtgatgtgcaaaggcgttatgggatgaaaccttcaattcagcattttggctgtttagtggaccttcttgctagagcagggcgtttgaaggaagctgaagattttgttaatgcaatgcccattgaacctgatacagtcctttggaggaccctcatatgggcctgtaaagttcatggcgatgctgacagggccgagcggttgatgaagcaccttgagatacaagacatgagggctgatgatagtggaagttacatacttgctagcaatgtttatgcatccacgggaaagtggtgtaacaaggcagaagtgagggagttgatgaataagaagggactagtgaagccgccaggaactagtaggattgaggttgatggtggtgtgcatgagtttgtgatgggagattacaatcaccctgaggcggaggaaatatttgtcgaattggctgaggtggtggataagataagaaaagaagggtatgatcccagagtttcagaggtcttgcttgagatggatgatgaggaaaaggccgttcagttgcttcaccatagtgagaagctggctcttgcttatggactaatcagaataggtcatgggtctacaatccggattgtgaaaaacctaaggtcttgtgaggactgtcacgagtttatgaaactaatctctaagatatacaaaagagatatcatagtaagagacagaatacgtttccatcattttaaaaatggagagtgctcttgtaaggattattggtagcttcagaattgtccttgtgaagaatgcccactgtactgtcacattgacaaatgcagatgccaaagaatgttccacagtagcatggcaaacaaaacatgcgaacaaaaaaaagttgtgaagaatgtcccgtgtacagtcacatgacctactagctttgatgcctaatacgggcattgatgaatgcaaatgccaaagctgagccgtgatcgcagattctgatcaaatgtcaataaacgggaaatgttgttatcaa

SEQ ID NO: 178 - DNA, 3844 bp, Glycine max
  misc_feature (1)..(3844): Glyma.06g046000.1
ggcacacaaaggtagatgcagatctgcatataacataatactacactttgcttttaattaaattaaattttagcagggtcacacagtgttcgtgggagagtaaagcgtgggttagtgttagtgaagttgacgattgcctgccttgtttgccgtgtgtctctgattctgtttcaactctatagaagaagaagaagaagaagaagaagaagaagaagaaacgtagttaaaaaatctcagtccgttccaaaacgctttttgttgttgtgtggtgaggttggttgaatgagctaaagtggaaagttgagttgaaagcaagagaatagatggagatttacctgagtgagaatttcggagatgtgaagccaaagaactcatcggaagaagcgcttcagagatggaggaaggcttgttggctcgttaagaatcacaagaggaggttccgtttcactgctaatctctccaagagattcgaagctgaggctattagacgctccaatcaggagaaattcagagttgcagtgttggtttcacaagctgctattcagtttatccacggtctaaatttgtcgagtgagtacactgtaccagaagaagttaaagcagcaggctttgaaatttgtgctgatgagctgggatcaattgttgagggacgtgattcgaagaagttgaaaagtcatggtggggttgatgctatcacaaacaaactcaatacctcagttgatgatggtatatcaacatctgagcacttggtgaatcagagaaaagaaatttatggagttaataaattcgctgaaagtccagcccgtggattttgggtttatgtatgggaatcccttcaagatacaaccctcatgatacttgctgtctgtgccttggtctctttggtggttggtataataatggaagggtggcccaagggtgcacaggatggaattggtattgttgcaagcatattgcttgtagtgttcgtcactgccacaagtgactacagacaatcactgcagtttaaggatctggataaagagaagaagaaaattacagttcaggtcacgagaaatagttgtaggcagaagctttcaatgtatgatctgcttcctggtgatattgtccatctaaatattggagatcaggtccctgccgatggcctttttgtgtctggtttctctgtgttaataaatgaatcaagcttgacaggagaaagtgaaccggtgaatgtcagtgaacttaatccttttcttctgtctggaaccaaagttcaagatggatcatgcaagatgcttgtgactactgttggaatgaggacccagtggggtaaactaatggctactctaagtgaagggggagatgatgaaacacctttgcaggtaaagctcaatggtgttgctaccattattgggaaaataggcctctttttcgcagttgtgaccttttctgtgttggtccaagggctttttagccgcaagctgcgagagggatcccaatggatgtggtctggtgacgatgcaatgcaaattgtggaattctttgctattgctgttactattgttgttgtggctgttcctgaaggtttacctttagctgtaacattaagccttgcttttgcaatgaaaaagatgatgaatgataaggcacttgttcgtcacttggctgcttgtgagacaatgggatctgccactactatctgcagtgacaagactggcacactaactactaaccatatgactgttgtaaaagcttatatatgtgggaagattaaagaagtaaatggttctaaggtctactctgatttctcatctgatattcatgattctgctctagcaattctacttgaatcaatatttaacaacactggaggagaagttgtcaaaaacaaagatgagaagattgaaattctaggatcaccgactgagactgcactgttggaatttgggctgtcacttggtggtgatttccataaggaacgacaaaggtcaaaacttgtgaaagttgagccatttaattctataaagaagcgcatgggggtggttctccagcttcctgatggtggtttcagagcacattgcaaaggtgcctctgaaataattctagcttcatgtgacaaagttgtggactcaagtggcgaggttgttgccctcaatgaagactccataaatcacttgaataatatgattgaaacatttgctggtgaagctctccgaacactttgccttgcttacttggatattcatgatgaattttctgttggaactgctattcctactagaggttacacttgtattggaattgtgggtattaaagatccagttcgccctggtgttcgagagtcagtcgccatttgtaggtcagctggtattgctgttaggatggttactggagacaacataaatacagcaaaggctattgctagagaatgtggaattttaacagatggtatcgcaattgaaggccccgagtttcgtgagaagagtgaggaggagttgcttgatatcattccaaaaattcaggtaatggcccgatcttcaccaatggataagcataccctggtgaaacacttgaggacaacatttcaagaggttgtttcagtaactggtgatggtacaaatgatgctccagcacttcatgaagcagatattggacttgcaatgggcattgctggaactgaggtagcaaaagaaagcgctgatgtaataattctagatgataacttttcgactattgtgactgtagctaaatggggccgctcggtctacgtaaacattcagaaatttgtgcagtttcagctaactgtaaatgttgttgctttgatcgtcaatttctcttctgcttgtttgactggaaatgctcccctcactgcggttcaacttctatgggtcaacatgattatggacactcttggagcacttgcactagccactgaacctcctaacgaggagttgatgaaaagaccacctgttggtaggaaaggaaactttatcagtaatgtgatgtggagaaatatcttggggcagtctatatatcaatttgttgtaatatggttcctccagaccagaggaaaagtaacgtttcatcttgatggaccagattctgatctgatattgaatacacttattttcaactcgtttgtgttctgccaggttttcaatgagattagttcgagggatatggagaggataaatgtttttgaaggtatactgaagaattatgtcttcgttgctgtcctcacttccactgtcgtcttccaaattataattgttgaattcttgggcacctttgcaaacacatctccacttagtttgaagcagtggtttggtagtgttctctttggagtccttggcatgccaattgcagcagctctaaagatgatccctgtgggatctgtctgaaatcaatgcagacaaattagttagccaggaaaatttgtggatgcctattattttgttggtgaagaccagaagagcaatgcccagaagtagaaagtgcttctattcaatcctaatgcagtggctattgacgaaaagtttggcttctcagagcctaaggtactcaatggatgggagtttattaggtctgttgtaagagaattgcatttgctcttgttcagcacaatgtacattgttctgtgaattgggcagctcccgctagtgtatctggtttaatattttttttcttcggtactcaacattctcagtgatgaggccgttggaacaaaattatttgattgtttgaaatagcaggtcaagattttaatcttgaactaactaaaatacaaagccgttaaaagatttcaacacagctcattccaagatctaccttggcttctttgtgctttcacctggctacaaac

SEQ ID NO: 179 - DNA, 1695 bp, Glycine max
  misc_feature (1)..(1695): Glyma.03g079800.1
tggcttttgaattcagaactttctctacctgctgctctggcacgttatcccatttttccaaaattcctccccaggatagaaactgactaaaaaaatattaaagctcctcattcaacaaaatcaacagggtagatcaacaaaacaaatgataatgcccaaaaagtccacccaaagtagttgagctaaacctccattacattaccccttcttacatacttacatcacccaaagactcattcatccccaaactcttaccaaatccacattaccctctctccctcccttcatgtccggagagccacggccgttggagatccacctgagggtcaactccaagagaggcaccaccatggtgcaccccgtggcggcggcggagacggtggaggttccgattcagtaccccagagaggaagaagtgaagcattacagaaagtggttctcttggctgatacctctctttgtggttgccaacattgttatgtttgtgatcactatgtatgtcaataactgcccgcgtaactctgtctcctgcattgcctccttcttgggtcgcttctccttccagcccttcaaagaaaaccccctcttgggcccttcttcgttgacgctgcaaaagatgggggctcttgatgtgagcagagtggttcacagacaccaggggtggcgcctcatcacttgtatgtggctacatgctggggttttccatctgttggcaaatatgctgggtattctagtcattggaattcggcttgagcaagaatttgggtttgtgctaattggactgctatttgtcatatctggatttggggggagtttgctttctgctctgtttatccagtcaaacatttctgttggtgcttctggtgcactttttggcttgctgggaggcatgctttcagaactcattactaactggtctatatatgataacaagctaacagcactcctcacccttgtgatcatcattgttatcaatctagcagttggaattctcccacatgtggacaattttgctcatattggaggctttcttactggatttcttctcggatttgtgtttttgatacgtccccagtttggatgggttaaccaacgatatgctcccctaaattattctccaggacgagtgaagcctaaattcaagaaatatcagtgcatcttgtgggtcttctccctgatcattctagttgttgggctttctgttgggctggttgcacttctccaaggtgttgatgcaaatgatcactgttcctggtgccattatctgtcttgtgttccaacttcaaaatggagctgccatacagaggcagcatattgtcagtcaaaccaacttggcaaccagttgaacgtaacatgctcaagcaatggtaaatccagtacatacttcatgcaaaatccaaccagttcccagatccagcaattgtgtactcaactttgtagttgagctttgacaaaagtgatgatcgttggaatgagatgttcatttgttcatattagtgtttcaggttctcacgaaaaactgcacactgcagtgctctttcgtttataccttctgccttacattttgcctttgtagatttgttcattttcttgtgtacataatattttgcttgatttgccttttttgggtacctttgtgtgagatcaaagttatacttatagatgattaatgtatcaccctaacttgtgtttgct

SEQ ID NO: 180 - DNA, 1325 bp, Glycine max
  misc_feature (1)..(1325): Glyma.16g153800.1
gaagtgacgcctacctataaagcataaaacccaagcgcgttgcttcctctgatccgaaacgaacctcaacaacgctgaacgcagaaaggggaaaaaggggattagggtttaggaagcagcgacaacaatggatttcacagcggagaagaaggaatcagagagcaacaccgaaaatgctcatccaacaactttagattcttcttctcaattggcatcggcacttgattccagcaacaaagaaatcgaagaacgacaagctcgtgaactcaaagccggtcttcaccccctcaagcacaagtttgtcttctggtacacgcgccgaacacctggagttcgaaatcaaacatcatacgaggacaacataaagaaaattgttgaatttagtacggttgaaggattttgggtctgctactgccatcttgctcgtcccgcttctttacctagtccaacagatttgcaccttttcaaggaaggaatccgtcctctatgggaggactctgctaactgcaatggtggtaaatggattatacgattcaaaaaggttgtctcaggtcgtttttgggaggacctgttaattgaccaggttcttgccttggtgggtgaccaattggattatggggataacatatgtggtgcagtacttagcattcgattcaatgaggatatattgagtgtctggaatcgcaatgcttcggaccatcaggctgtaatggctctgagagattcaatcaaacgtcacttaaagcttccacatagctatgttatggagtacaagccccatgatgcctctctgcgagacaattcatcttacaggaacacttggttgagaggctagagattcaattgtgttcttgccaaagtccccgccgtggaagctacattgcatattggtgcagctttcactcagccagttaatcattggcttcggtctagtgatagtgatggtgctgggtgttccaggactggtttctgtcttttgaattcaatgtacgacagctacattgctactactttaaatagtttcatttggttacttgcggttcactctaattttgtgtaatgtgtctcttagtttttgtaaataaactcgttcgtcttgttgcttttcacctcgcttatggagagaatcatggcttttctctcccatgatgtatgatagattacttctgtagcgcatttttacataaaggcattaatccttttaactgagacgatcaatatggcgggaagggatcaagtctcctactgtgggaaaattatttcctacagttagatgtatcaatttttaaatcaatggctcatttttttctttcttttttcttata

SEQ ID NO: 181 - DNA, 2808 bp, Glycine max
  misc_feature (1)..(2808): Glyma.12g137100.1
ccgcagccagcaaaactagcctgcttactccctcttgagctctctcgaactttccaggccgccctccgtcaataagtttgccttccctcggtgaagaggtccctcgcgtgtgtggtagttgaagtgcttagttcccctcagtgaagccctccctcgcgacgttgcgtgttcggttacacaagtgaaattcgattcaattacctttgcattttggtcgaagagctcgatggatgttgagccaagacgaataagattgttgtccaatagatatactacaaacacacttttggatactgctgctaccatacagattacaagatagtaaccacttagtaatcaaagagaaggtaggagcagaagatgcattagcaaatggttttccctctttagagccaagatcaaaatttgttctgtgctactttcaatctagtatatgaaacccattgcaactgaacttggaatatgatgtggacctgagaagaaaccaagctaagagttttttatcctacaaggagttcgtttttcttttcgttttcattaggttgtgtgtatttgggatccaagatctagatcaaagactttgaagctaaatgggcatatagataacatcacggccttatttctggattctactagcaagtttgttaattggacaccgtggacccaatcattgctgtgcagaagagaaaagcaatgagccaatgaatgaagtgaagtggtccttcggcaaatgaacgagtttgaatctacaacaaagtgagggtcccacgtgtccagcttgttcaaacatcccttgcaagtgtgttaactgttcaatgcacttttattattcttttgttgtgtgcgactgcttctgctcatcaaccttcatcagattctttaactcttctctctcagctttcttattgtattctcagtcacatttgcttcacttttttatcccttctcactgccacactgtagtttttgtggttgttgttttttgagttctgtgctaacataaagtacatgtgactgtctcaaggttgcctcttttgttctttttaccttgtatgaactggcgagtttttggtccaacgtggtacgcgtttttccagaacatgtttgctttttggccaaacgttgttgctgtcagtgttttgatctgtctggctatgtttttcagtaaagggtgttctgtgtttgtgtcattctatgctgatgtttcatttgcttaattggcctataaatggatttgatgatcaatagggaacaatagcaaatcagtgaagaggatatgagagaggagtcacttggactgattattggggtttccataggtgtggttattggactagttttggcaatttttgcgttcttctgccacaggtaccatcgaaagcgatcacagataggcaatagcagttctagaagggctgctaccatacctatccgcacaaatggtgctgattcttgtaccattctatcagactcaaccttaggtccagaatcaccgataaagtcaggaagaaatggtatgcccttctggcttgatgggtttaagaagagtagtagcatgatcccagcgtctggactacctgaatatgcatacaaggatttgcagaaggcaacacataatttcaccacggtcataggacaaggtgcatttggtcctgtttataaagctcagatgtctactggtgagactgttgcagttaaagttcttgcaatgaattctaagcaaggggagaaagaatttcacacagaggtcatgttgttgggaaggttacaccataggaatctggtgaatttggttggatatagtgctgaaaaggggcaacgtatgcttgtatatgtatacatgagtaacggtagcttggcatcccacttgtatagtgatgtgaatgaagcactgtgctgggatttgagggttcacatagctttagatgtggcacgaggcttggaatatcttcataatggggcagttcctcctgtaatccatcgagatatcaaatcttccaacattctgttggatcaatccatgctagccagggttgctgattttggactttcaagagaagagatggcgaataagcatgcagctattcggggtacctttggctatcttgaccccgagtatatatcttcaggaacattcaccaagaaaagtgatgtatacagttttggggtgttgctctttgaaattatggctggcaggaatcctcagcagggtcttatggaatacgtagagcttgcagcaatgaacactgagggaaaagttgggtgggaagaaattgtggattctcacctccaaggaaactttgatgtcaaggaactcaataaagtggcagcacttgcctacaaatgcatcaaccgtgccccaagtaaccgtccttctatgagggacatagtgcaagtgttaacaaggatccttaaatcaaggcaccatgggagtcatcacaaaaattccttgtcagccacagatgaagttttcattgatactgatcagctagagaccaagatttctgttactgaccacaggagagaagagtctatggatagtgtagcagaggtgtatgaagtgtagaatatggttttaccataacctcatttatttttgttacattttatttttcgatattgcctttggatgtacatgattgtagatttggtttgtatatactgctttgtaaaatgttccatccaattttgtgatctttcctcagttatattgtcttgctgaaatgatactctaaaaattgtattattttttgtcttgttacgggtatctttcaatcaagtaagtcaaaaattaattttactcgtgtt

SEQ ID NO: 182 - DNA, 5397 bp, Glycine max
  misc_feature (1)..(5397): Glyma.17g039300.1
caggctagaagcttgttgcttcacaaaatgaagtagaaaaggaatgaaccatgccactttgatatatccttgcgtgctcttattaaattctgaccacgtataccttcctgtttcttactaaaatattttcaatcatgtctcagcatggactttggtgattaattaatgtatcagtgaaagctcagttacaataatagtataaaaaaggtttgtagttgtattccttttcattagataccttaacagcatgttcaattccccattcacatgacaaaatgcattgcatcatcaaagaggccaatatcaagcttataaacacagcatggaagtttctatataatgttcagaagaggatcaaaatatgatgcattccacacatatctgagttttaatccccttagtgttgtgttgagatggcacagctggcaggtgcggatgagatagagtctctgagaaatgagttagcagagataggaaggagcataaggtcctcatttagaagtcatgcctctagtttccagagcgtttcaagcatcaatcctgtgcaacaagaagttgataacaacgccggagaagcgttacaatgggctgaaattcagaggctacccacctttgagagaattacttcagctttgtttgatgtttatgatggcatggaaacaggtgagaaagttgaagggaaacaggttgttgatgtcagcaagcttggagctcaagaacggcacatgttcatagagaagcttattaaacacattgagaatgataatcttcgattgctgcagaaattcaggaacagaattgacaaagttggtattaatttgcccacagtggaactgaggtaccaaaacctgtgtgtggaagctgagtgtaagatagtccaaggcaagcccatacctacactgtggaataccctaaaagaatggatctttgacaccactaaattgccagttctgaaatctcaaaattccaagataagcatcatcaaaagtgccaatggaattattaagcctggaaggatgaccttactgcttggcccaccggcaagtggtaaaacaacattattgttggcgttggcaggaaaacttggccattctctcaaggttcaaggggaaatttcttacaatggacacatgctagaagaattcattcctcagaagtcctcagcatatgtaagccaatatgatctgcatattccagagatgactgtgagggaaacacttgatttctcagcacgttgtcaaggcgtaggaagccgatccaaactcctgatggaagtcagtagaaaggagaaagagggaggaatagtcccagacccagatttagatgcatatatgaaggcaacatcaattaacggactcaagagcagccttcagaccgactatattttaaagatacttggtcttgatatatgtgctgacacattggttggagatcctataagaagaggtatatctggtggtcaaaagaaaaggttaactacaggagagatgattgttggaccaacaaaagcactctttatggatgaaatatccaatggtttagacagctccactactttccagattatctcttgtcttcagcatctggtgcatatcacagatgccacggcattaatttcactccttcagccagcaccagagacctttgatctctttgatgatgttattttgatggctgaagggaaaattgtgtaccacggaccgtgtgattatatacttgagttctttgaggacagtgggtttaaatgcccacaaagaaaaggcactgctgactttcttcaagaagttatctctaagaaagatcaagcaaagtattggaatagcacagaaaaaccttacagttatgtttcaattgaccagttcattgagaaatttaaggattgcccttttggtctaaagctgaaggaggagctctcgaagccatttgataagtctcagagccacaagaatgcccttgtatttaaaaaatactcattaacaaaatgggaattatttaacgcttgcatgatgagggaaattcttctaatgaaaaaaaactcttttgtttatgtattcaagtcaacacagcttgtcattgttgcatttgtagcaatgactgttttcattcgaacacgaatgactgttgatgtgctccatgggaattattttatgggttcattgttttattcactcatcatacttctcgttgatggatttccagaactatctatgactgtatcaagacttgcagtgatttacaagcaaaaagagttgtgtttttttcctgcctgggcttatacaattccatctgctgttttaaagattcctctttcattgttggaatctttcatttggacaacactttcttattatgtcattggttacagccccgagattggcaggttctttcgccagttccttctcttatttatcatacatgtgacttcggtatccatgtttcgattcattgcctcagtttgccaaactgtggttgcttctgtgacagctggtactgtgaccatactagttgttttactatttggtggcttcatcattccaaaaccatatatgccatcttggttgcagtggggattttgggtttctcctttgacatatggagagataggcttaactgtgaatgaatttcttgctcctaggtgggaaaagatgtctggaaacagaacattgggccagcaagtacttgaaagtcggggactaaactttgacggctacttttattggatatcaattgctgccttaattgggttcacagtgctgtttaatgtaggttttaccttgatgttgactttcttgaattctcctgcaagatctcgaactcttatatcttctgagaagcactcagaattacaaggacaacaagaaagttatggtagcgttggtgctgacaagaaacatgttggttctatggttggaagtactgtacaaaccagaaaaggaggactggttctaccattccagccactagcagtagcatttcatgatgtccagtactatgttgattcccctttggaaatgagaaatagaggttttactgagaaaagacttcagcttctttctgatatcacaggttcactcagacctggcatcctaacagcattgatgggagtcagtggagcagggaaaacaactttgatggatgtcctgtgtggaagaaaaactggtggtattatagaaggagagattagaatcggcggctacccgaaggttcaggaaacatttgctagagtatcaggttactgtgaacaaaatgacatacattctccaaatataacagtagaagaatctgtgatgttttctgcttggcttcggcttccttctcaaattgatgcaaaaactaaagctgaatttgtaaatgaagtcattcatactattgagcttgatggaatcaaagattctttagtaggcatgccgaatattagtggtttatcgactgaacaaagaaaacggctgaccatagccgttgagcttgttgctaatccttcaatcatatttatggatgaaccgactacaggtctagatgcaagggcagctgcagttgtaatgagagcagtgaagaatgttgttggaactggaagaactgttgcatgcaccattcaccagccaagtattgatatatttgaggcatttgatgagcttattctcatgaaagctggaggtcgcttaacctacgctggcccacttgggaagcactcaagtagggtcattgaatactttgagagtataccaggagtgccaaagattaaagacaactataatccatcaacatggatgctagaagttacttcaagatctgcagaagctgaactcggaatagacttcgcccaaatttatagggagtcaaccttatatgaacagaacaaagagttagttgagcaattaagctcaccacctccaaactccagagatttatattttccatctcattttccacaaaatggttgggaacagtttaaagcatgcttgtggaaacaacatttgtcctattggagaagtccttcatacaacttgatgcgcatcatttttgtggctgtctcatctcttctgtttgggatactgttctggaagcaaggaaagaaaataaatagccaacaagatgtgttcaatgtatttggtgcaatgtactctgctgcactattctttgggataaataactgctcaacagttttaccatatgtggcaacagagcgcactgttctgtaccgtgaaagatttgctggaatgtactctccctgggcctattcttttgcacaggtgctaattgaggttccctatatattcattcaagctgttgtatatgtgataatcacatatcctatgttgagctatgattggtctgcttataaaatattttggtcattcttcagcatgttctgcaatatcttatattataactacctagggatgctcattgtctcattgacgccaaatgttcaattggctgctatcgtggcttcatcttcctacacgatgcttaacttattttctgggtactttgtaccacgactacgaattcccaagtggtggatttggatgtattatttatgccccatgtcttgggcactgaatgggatgcttacttcccaatacggagatgtaaacaaagaaatttcagcctttgaagaaaagaaaacaattgccaaatttttggaggattattatgggtttcaccatgattttcttggtgtagttggtgttgttctcattgtcatccccattgtaattgccattctatttgcttattgcattggaaacctcaatttccagaagaggtaaaatgatgtaacttgcaaaggtatcattgtgaatcattcgatgaaataaaacaatttcttgtaaattttagtctacaagagaatcttgtgcaaacaagatgcatgcatcacagtttactccaaccataaaaaggaggagaaagaaacgtctccattcactggacaacaagcaggcaaacagagaagcgtagacaattgggtacacaatgagcaccacagccacaaggcttaatctgtcatgccggaagccatagtaatctcttaaaaaggaaccaactgattttcgttccccaaatacgagtacctccttctctatgtctccatattgtgaagttaggaggccattcaaggaccaagcagtaggacaaatccagtagcaccaaacccaccatttaggaattttctgcataaaaaaacttagttgttatgtcaggctttaaagcatctttcttatccttattttccaaattagtgttgtttctgtgtgcatcatgctataaagaaaaattcaagtaatgattatccatgatagtggttttgattatgaatttgatgttgatagactctatgatctttcaacaatggaatggattacattttgggaaaggataaaattcatctttaaa

SEQ ID NO: 183 - DNA, 956 bp, Glycine max
  misc_feature (1)..(956): Glyma.01g157600.1
ttgttaataacgaaactaaaacgaaatctagcgatattatcgaagcgcaaaacgagaagtaggatctgttgttcttcgttttctacgaggaagcaaaataacaataacagaggaagaaagaaaatcacacagtttcagtttcagtttcagtttcagcttcgctttgtagaaatggctactctatcaagcttcattactacgccgaagaatcccaagacccactttctctcaggttcctcattcatgtcgatggacaaatgcttcttgaaaatcagcaccagcggacactttacagatttctctttaagggctaaagcaacaagtaaccaaccacttgttattcgagctggtggtgatggtggaagaccaagtagtggaagtatttttgttggtggttttgtattgggaggactaattgctggagcattgggttgtctatatgcacctcagataagcagggcactagctggagctgacagtaaagacttaatgaggaaacttccaaaattcatgtatgatgaagaaaaagcactggagaggactcgcgaggtgctaactgagaaaatagcgcagttgaactctgccatagatggtgtttctgcacagttgcggccagatgaagactcaaatgaaattgccgtgaactcagaggaaattgaaataccaatcagcgatgaaagtgaaatcgaagtcaacaaataaaaagctgttgtcatttactccaagttgacgtaacaaattgcttttgcatcattgaatctattaatgtatgtacttgacacaagttggttccagcaaacgtagattatgttctgttgctgaacaagtctccgttaaatagacaatttgttacattgacaagttataccaataattcatttaatttactgtccatctttttcttataacattaataatattgagggcggatacgtgttaatttttttaatattcaa

SEQ ID NO: 184 - DNA, 1407 bp, Glycine max
  misc_feature (1)..(1407): Glyma.07g099000.1
tttacaacagacttaaatatgtttttacattttaaatttgggttattgttgtttttgctccattaattttttttaattccttaattttaaaaagtgttctttttatttcctcctaattgatttttaacgaatataagtaaaggatggatggcacctttttttgtcttttgcgtgagtgctagctgggattagttttatgggagtataaagcctaaagaccttattgcttttgtatcttttggtgacatcagtggcacatcttccttttttattactataattatgttacttgtatgaagaaaataaaatacctaacacttcatccatggttagtaatgggcgtcgttttctattgggaatttcgatgacagctcgaataaaagtatgattgattattccatgcattttcgttacattataaatttcgtgattgtgaagcagggttggtatatgaatttggtttcagctttcaacataaagatggctcggaccactctttcatctatatttgtacctttcctcattttgctcgtaattgccattactttctttgcagagcttactccagttagtgcagatctgaaaatgagaaaattgggttcacacccaagtccacctcctccacccttgcgtgccccgtctcggcatactcgtcctcctcgtcctcggcatcgtcatcctcctcctcatcctccagccatttcctaacttttcatgttatttgatccctgcaatattacaagaaaacatgagggaatcaaggttcatgatttgagtttttcttcgatcagcaggcacaaaatttcaacaggccggccgaccccttcattaagttgttggcataattttctatgggagatttcattgaaaactcaaataattaaaagtatcattgactctcatgcattcgtgactataaatttcggtgactacgaagcaacctggtatattaatttggtttcagctagtcttcaatatacacttggacatggctcaaaccaatctttgttctatatctgtaccttttcttattctattaatgatcgcctttaatttcagtgcacagattactccagttagtgcagatctgaaaatgagaaaattgggtctcatgccaagtccacctcctccaccccagcctggcaaaccacaacatcctcgtcatcctcctcggcaagatggtccctaactgtgtgttacttgatccctgcaacattacaaaaaatcatttgagcctgatcaagctttaattcatactcattttctttatataaatagctttacattatttggtttatgtccaaataacactatctgtctaaaggcaggatatattgaatattttattcaaagcgtgtatgcatgtgcaattagatttggagaaattaaaagcttttttatggatta

SEQ ID NO: 185 - DNA, 3560 bp, Glycine max
  misc_feature (1)..(3560): Glyma.16g195300.1
aggaaaaaatcttttttttcctaaaaaaacaaaaaaaatctcttcaccaaaacaaatattctaaatcgaacacgcaacctccctgagtcgctgcaaaagaaggcactcttatccgttttataacggtgaaagcaaaacctgttgccaaagaattaaaaacaagtaagctcgctcattgttctaccgattgaaagcacgtcgaataagcgcttttaggatttaaaggggaaaacttgaagtgcctctggataagtggtggagtttgtttgtttgattgattttgcaaatcagttgaatggtaggatccccaatcacccaacaagatcaggtgtgattgaaggaaaaaggggcataggggaagttgaagtgaaaaatgctgagtgatagagatgggaaagaggacatggacaggcttagtgacttgcctgaccttgttttgcttcatataatgaaatttatgagcatgaaacatgctgttcagacttgtgtcttgtctacaagatggaaggaactgtggaaacgtctctcgaatttggcattgcattcctcagattttaccaaccttgcacatttcagcaaatttttatcatgggttctgttgaatcgagatagctccatttccctgcatagtctagatttgaggcgtaaaggctgtatagatcatgaactcctggacatgatcatgggatatgctgtgtcacatgatgtccagcagttggcaattgaagttaatttaaatgctaaatttggttttaagttgcaccctagtatcttttcttgtaaatctttgacatttcttaagctttccatctgggctgtcccttggatgactgaacttccaagttccctgcagttgccagcattgaaaagcttgcatcttgagcatgtcactctaactgcaggtgaaggtgactgtgccgagcccttttcaacttgtcacatgttgaatactttggtcattgaccggtgtaacttgcatcatggtgcaaaattcctctgcatatgtaattccaacctttctactttgaccataggtagtaccattcaagaaacaccctacaaatttatactttctactccaaatcttagatctctttccgtgatgcgtgatcctattcaccaactctctgcttgcaatctttctttacttgaacaagtaaatattgacgttgaagcctattttgatgctcattttcaaaggacacatttagcccttataagtttgctgcaagtgctcgcagattatgcaaagataatgatactctcttcaagtacccttaagattctaaatggtctctcaacttctggttcaatgataacacaaatcccttgctttgttcaattaaagtcattgaaattgaaaatgaaatcttcttcaaacatatctgatgagggagttagcaggatagtagagtacttaattataaaatgtccggtggccaaagttgatattataaattgctgagagtgataagaacacttaaatcctcaggtagtatgttttacatattgttctgattttgcttcatttttccttctcttcctgataatactagcttagtctcttctcaatactcatagtcacagcaagtgaaaggttgctatataatttccttgtcgatcctcttgtaaccttgtttttgctatatttggctttggcacatgacaatttttaagtaactattactggggacagtctttttgttatacttgtaattttgatcatccttgaataacagaactgttgaaggggggaaaagatcaaaagactactaaaagaccacttgatagactgatgaatctgaagtttctttttttgttggtgtaatatgttgcatcattgcctagtcttaaggagagcctctgtggtagtggtgctagccttatggaaattatgtgtatcatgctcctaccgatgtaactaaattattatattagactatggagttgttgtatgaactcatgtcaaagttactatgatgagtatgtttattatttcttattgattactagtaattgagttactaaatgcatgtggtgagtttgtttaatatggatttgtttattatgtcttattaattgctgagaaatgcatgtgatgagagatgaatttgtttaatattaggattaggaaacgctatataggatgaatgggacataggactggagataatggaatcttagattatcaaaagaaaaactgcatggccacgagtaggaataagaaaaaatatttttaatgtagaattaagcagggtttcatgagtattatttgaatcttgaataaacaagttttataaggtaggttttagctctcttaaatcaagatattctttctttgaaacatatgatccatctttattttgatattttccttgagaccaaaatttttggtttcaagtcatacaaattacttgccttttgtgaatcttggaacaagtgttctattcaaattctttagaataacgtgaggtgcatagtgaaaaagcgaaaccgtgcttccaacacaaaatgtcccacaacacgtatgttattcagttcagagttttattatgtgtattgcaaaaatttaaaacccctgccaattacaacagatttgtatcttgggttctatatagtggagatggttcattttacttacttaatcttcgttgccagtgctactgcaatgaaatgagtccaaagtgtgtcatgaaatatgttgtgctgcacaatttcataacaacagtattggtacggatgtctatttcagatacaaatccaattcatttgtccctctgttttactgtccatcttagacatttcttaagcttaacatcagtccttatggctgttaccttgaacttccgaaatctctgcaattaccggcaagaaagtccttcagaaagtagaagctgaccaaaagattattccataaccgactcttgttgctgaatcaaaggggattagccgacaaattacttaattttctatgaatttttcatttatcacttaacaagtgaactttgcttatttctttttttaggatcggcgaatcaaatgatatttctgttccaaattttgtctcttctccctctgaatcacacttttcctgtgccttttacaaagtttatatttgttgaaaactttgtaaatttctgaatgttccttgcatcatgatgcaaaattctctgcatatataagtttgaatctggagtttatctgctgccagtacaaaattgtactttctactcccaatgctagttctctcacaatcatggatcattcctgtttcagttatcatgaactatcctccacatgcagcacttatatatcttatcctgtcatcataagccggctgcaagtgttggcaaatgtaaaagatattgacactctccttctggtatcctaaaattagttttaaggtttaaatataatttttgtttctacactttaatgtttttttatttttgtccctgaaaaaaattattttagtccttctaaaatgtgttctttttttcatccttgaaatattttagataatattttttttctttgtttaaaatattttttattgttca

SEQ ID NO: 186 - DNA, 1405 bp, Glycine max
  misc_feature (1)..(1405): Glyma.16g073700.1
cagttcattagaagaccgagaacgatatcgcttttgtcaaacttggtgtgttaatggagtatttgatacttgagtccctaatttaatttgctagggaaagctacggttggaccaaaatcaaccagtacctacttgaaaccgagtgaaaaaacctactactcccactcccagtgactgagtgaaaaaccacaacctagaaagaaatgaagaaaatacagcactctgaacaaaaagcaacggaaccaaccaaaaaggattcaaagggcaacaaacaagaaggcacagactcagagtcagagcaataccaaaacgaagaaaatcaactccacacgctttcggaaccatcaccatccttctctctccgttcccgcaaatccccttcgccaccactccactccctctctgactcccccatctccgatgcccacctctcccctgcgccgcagaagccgccgcccgattcctcgccggactcctcgatctccgacggccacttcacgatcggtgaacagcgcctctccccggcgccgccgaccgtggtgacggctcatcggttgaaggtggagcccgcggtgttgaccagggtcgatcccggcgccgaagagggtttcgtgaaagacgtcgaacaagccaccggcagcgccggtagtcgacgcctcagaccggatatgaccggtttgttgaggtcgaaaaaaatcgccacgtggagcaagctcttgctgggtcttcgagtaaccgcttttgttttctgcttggcgtctttctcggtgttggccactgataagaaacagggctgggctatcgactctttctatttatacaaggaattcaggtatagtttgtcagtgaatgttattgggtttgtgcattccgcgttgcagatatgtgatcttgggcggtactttgcaacgggaaagcacttggtggagcaccagctaaggggttatttcactttcgcgctggatcagatcttgacataccttctaatgtcagcatcatcatcagctgccactagagcttatgattgggtttccaattggggtgaggacaagttcccctacatggcaaatgcatctgtggctttgtccttggttgcttttgtggcctttgccttagcctctcttgtctctggttctattgttgtaaggttcacataatttatacaagtactatgtgtgaggtgtgcaaactcttatctgagatactggattaagctttatcctttctcgattgaaaatcgtcccatattttcagaaggcagactgactcactttgtacagaagggaaactcactttatttctctgtcaactttaatttgtatagatgcaggtggatttacagcttgctgaactggcttgtatatgaacttttgcattattgagatggtattaagcttactttttt

SEQ ID NO: 187 - DNA, 3244 bp, Glycine max
  misc_feature (1)..(3244): Glyma.16g144000.1
aaatgatacaataataaatgaagcatatcccgcaatcagagaaaatcaaaagttttcctaatacaataatacctatgtgaagatgttaaaacaaatacaatgcgcttttctatacataataaacttaatcttgtaaataacctttattacagaaaattcattatttttttttctttcttctttgttttcgttgcaaatcaaacaagatggaaagaattctatttattccttccaattcactccaatttctttcaaatcaaataatccaaaaatcctttctattctatccatcctgttgccccaaacacagcggcacagaggcaatttatcgtgaagagcaggggcttttctgtgccgaagaaaattcaacaaaggccatattcgtcattcagcaaaaaagaaccgtaaaatgaggacatgtattttactttacgttacggttccataacaagtctgtgatcttagccgccacagaacaattacaagcgtgtctctgtgaaccataagaaccttctcagaaaatctccctcattgattcataaccaaacgctccctgtcttttataccatgcttttctttcattccatagttttcttctttacaaacaacatccatagacaactctgttttatttcttatagtacatgacatttcattgatgttgaagctcgatcttcgagttgtttggtttggtgagtaactcctgccactgccacacccattaattctccaaacgttacccagccctgaagctaaagctatcaccagaagggtgatgattacaatttataacactgttccctcaaatctccagaaaatgtttcactacaacacaaagttcgctatggtcctcactttctttatcttcatgttctgttttttctgttcaacgagcgccagaagtaacaacaattgcgagcgtagctgtggagaacattccctgcaatacccttttggcttctcttctgattgcgaagtgaaactaaattgcagcaaagagaacaaagctgaaattggcgagttagaggttcagagcgtgacctctgatggcatcttcgttagtcttccggtgcagtgcaaccgcagcgtgagtttcattgaccctctcttcagagacaactttgctcccacgtggaacaacacctttcttgtgcagagctgcaagcccaagctcgatggctgtgttatccccacatcgagtttcgctggcggccgcaaagatgtggaggggtgtgaagatcttagttgcttcacgcagttgcagaagagtaagagtaatggctcgagggaagatgatgttctcacgcacagtgattgggagcgagttgggtgtagattcttgttctctgctcttgcttttgataggagtaaagtgaaggagctctcgctccaatttcagatggttgaattggggtggtggcttcaaggaaactgtagttgctccaacaatgcgtcctgcacggaggtgaatactgatggtggaaaacgaggcttccggtgccgctgcgatgaaggtttcatcggagacggattcagagccggcgatggttgccggagagtttctgaatgcaaagcttcaacactgtggtctggcggatgtaggaaagcagtcaaaattggtgtccttgttggagggatcatatttggaggtatccttgtggctgctctgtttcttgtatgttactttaataggcgtcagtcctcttggctgagaaaacaagtgacagtaaagcgcctattacgcgaagctgcaggagattccactgttcctctatatccctacaaagaaatagagagagccaccagttttttctctgaaaaacataggctgggaactggggcttttggcacagtttatgctggacaccttcacaatgatgagtgtgttgctataaaaaagattaagtatagagacaccaacagtgttgaccaagttatgaatgagatcaggctcctttcttcggtgagtcacccgaatttagtgcgcctcttaggttgctgcatagaagggggagagcagatacttgtttatgagtacatgccaaatggaacactatctcaacatttgcaaagagagaggggtggagtacttccatggacaataagactcaccattgctactgaaaccgctaatgctatagcatatctccattccgcaaatgatcatccaatttatcatagagacataaaatccagcaacatactcttggattataattttcaatcaaaagtggcagattttgggctttctaggcttggcatgtcagaaacatcacatatttcgaccgccccacaagggaccccgggctatgttgatcctcaataccaccagaacttccacctttctgataaaagtgacgtctacagttttggagtggttttggtagagataataacagccatgaaagtggttgatttcgcacggcctcagagtgaaatcaacttggctgcacttgctgttgataggatcaagaagggttgcatagatgacatcatagatcccttccttgagccacatagggatgcttggacgctctattctattaacaaggtggctgagcttgcatttagatgccttgcttttcatagtgacatgaggcctaccatgattgaagtggctgaggagctagatcttatcaggcgcagtgggtgggcgaccatggaggaaaccatatgcatggcttcttcggttgggtccgtgtgttcatcgcctcgaaatggaagtgttaattcacttagaggtgttagttttgagagagctgcaggacttgggagtgagacattgattgttccccacaagactgatgtttttttgcaatcaattgaggaggtgaaggacagctctcctgtgtctgtgcatgatagttggttaagtggaactagctcaccttcaacaaatagcttgttaggacatgtagttcagtgacatatatacttattttgggtggaacacctattatttgaatggcaaaggtcattaatgttttccttttctcttttgtagttgtaggatataaccattttggtgtatgattggcaccaggattctgctttcgtttttctctctgaatcgtactaactcatccaaggcagttaattatgtttgaccaatcctaagtaattaataaacagaattcactattctttgttcatacagaaagtgatatatgaagagctaccatgtacaattgttgctggaaataaccaacgcctgagcctatagctatcttgtttgtatttgttt

SEQ ID NO: 188 - DNA, 2077 bp, Glycine max
  misc_feature (1)..(2077): Glyma.12g107000.1
aggatctaaccactttgtctgtctgaagttgaaacaagaacaacacttctgatatattaaaaacaaaaacttcagagttcaaagctgtgaagtaaaagctgctaacccaaattcttgtcagtggtaaccatgacagttggttccttcttcatcaggacctccagggttctcaactcctccaactttctgcttctctgcactctcagtggtggtggtgtagtggcatactcagaatcacaatcaggagctgaacgtcctagtattgaagctaatgagcctgccaaaaagaaagtggtggttcttggaacaggatgggctgctaccagtttccttaaggatctggatgcttcattatatgatgttcaagttgtttcacctcgtaactactttgcatttactcccttattacccagtgtcacttgtgggacagttgaagcacggagcattgtagagccggtccgaaacatcattaaaaagagaaaaggagaagtgaatttttgggaggcagaatgtgtcaagattgattattcgaacaaaaaggttttctgtcggtccaatattgacaacttggtgggaagtaacgaattttccttggactatgacttcttggttgtagcagtaggagcacaagtaaacacttttaacacccctggtgtcaaggagaactgtcattttctgaaggatgttgaggatgctcagaagattagactgtctgtgattgattgctttgagaaggctgttcttcctagtctatctgatgatgagcgaaggtcaaatcttcattttatagttgttggaggaggtccaactggtgtggaatttgcagccgagctgcatgattatgtccaagaagatctaatcaaactatatccaactgttaaagataaagtgaaaataacattgattcaatctggagatcatatcttgaacatgtttgatgaaagaataagttcatttgcggagcaaaagtttacaagagatggggtagaagttcaaacaggatgccgggttgtcgctgttaatgacaaggatattacagtgaaggtgaaatcaacgggagatgtttgctcggtgccccatgggttgattgtttggtcaactggtatttcaactcttccagttataagggactttatggaagaaattggtcagactaaaaggcatgtactagcaactaatgaatggttgcgtgtgaatggatgtgaagatgtgtatgccattggtgactgttctagcataactcaacgtaaaatcatggatgatatcacagccatatttgaggctgcagacaaaaataactccggcaccttaactattgaagaattccaggaggtgatggatgacattatcttaagatatccacaagttgagcaatatctaaagcagaagcatctgcgtgattttaccactctgtggaaagatttgcaagggaatgaaagcaaggaaatagacatccaagcgtttaagctggccctttctcatgcagattcacaggtgaagagtctgccagcaactgctcaggttgctgcccaacagggtgcatatctagctaggtgctttaatcgcagggatcatactgaagagaatcctgaaggtcctcgacgatttagcggatctggacgtcataggtttctccccttccggtataggcatttggggcaatttgctccactgggtggggagcaggcagctgcagaacttcctggagactgggtttccatgggtcacagcactcaatggctttggtattctgtatatgcaagcaagcaagtgagctggcgcaccagggtcttggtcatgtctgattggacaagaagattcatatttggcagggattcaagtagagtttaatttgacaccttgtttctctcttgttaatttttgtacctaatgttagtgatatatgttgatggaacagcattttgctccattctcgattgggaacagtttgagaactgatattagattttcattgagtgcttatgttgtttacagcttccattttgcatcaatatatgtggatttgaatcctttcaagcctattctctcatgttccctccaacgtatgagagaaaaa

SEQ ID NO: 189 - DNA, 207 bp, Glycine max
  misc_feature (1)..(207): Glyma.06g214100.1
atggcactcacttctaaggccattaaccaagaatgcaagaagcatgcatgtggcaacaaagacggtgattggtatctttattatgctcctacagcttgcactgaaggagatgatcataaaggcaatggagattcctgttttggccatattgcatacatgaaaggtgacgacgacagtgatatctatgactatgctcccgcagcataa

SEQ ID NO: 190 - DNA, 1823 bp, Glycine max
  misc_feature (1)..(1823): Glyma.18g247300.1
atttgggccatctattagatctgtcacatacacacccacatcgaccatcttctctcttctctcttccttttcagatcacacgcacacagttacgctcttcaaatctatctcttctcagcgattcttgcttcaagttccagaaatgggtgtggctcaaaacattcccgatgcggaggagggaaccttggagattggaatggaatacagaactgtttctggagttgctgggccattggtcattcttgataaagttaagggacccaagtttcaagagattgttaacattcgcttaggagatggtactactcggcgtggacaagtgctagaagttgatggtgaaaaggctgttgttcaggtctttgagggtacatctgggattgacaataaatttacaactgtgcaatttactggagaggtgttaaaaactccagtatcattggacatgcttggccgcatattcaatggttctggaaaaccaattgataatggtccacccattttacctgaggcttacttggacatatcaggaagttccatcaaccctagtgagagaacctatccagaggagatgatacagacaggaatatctaccattgatgtcatgaattctattgctagaggtcaaaagatccctctattctcagctgctggtctcccccataatgaaattgctgcacagatatgccgtcaggctggcttagtcaagcgactagaaaagtctgataatcttctcgagggtggaggagaagaggacaattttgccattgtgtttgcagctatgggagttaacatggagactgcacagtttttcaaacgtgactttgaggaaaatggctcgatggagagagtgacccttttccttaatctggcaaatgatcctacgattgagcgtatcatcactcctcgtattgctcttactactgctgaatatttggcatatgaatgtggcaagcatgttcttgtgatactaactgatatgagttcttatgctgatgctcttcgtgaggtatctgctgcccgagaagaagtacctggtagacgtgggtatcccggctacatgtatacagatcttgcaacaatatacgaacgtgctggaagaattgaggggcgaaaaggctctattacacaaattccaattctaaccatgcctaatgatgatattacgcatccaactcctgatcttacaggatatattactgagggacagatatatatcgacagacagttgtataacaggcagatatatcctccaatcaatgtccttccatcattgtctcgtttgatgaagagtgccattggtgagggaatgacacgaaaggatcattctgatgtgtccaaccagctctatgcaaattatgccattggaaaggatgtccaggcaatgaaagccgtggtcggagaagaagcactttcatctgaggacctgctgtatttggaatttttggagaagtttgagaggaagtttgttgcccaaggagcatacgatacacgcaatatcttccagtcactagatcttgcatggactttgcttcggattttccctcgcgagcttctccaccgtattcctgcaaagactcttgatcagttctacagccgagatgccagtaactgaggatataataatagcaaggtcttataagttataccttagtcacatgctcaatcatcttgtaatgaccctgactattgttttatttcttagatttctcatccaacaatctttatttcttctatcacaccatattcatcatatataataaaaggtttgagtgcctcagtttgttggatattttgatttcctgtgccatgttttttcaattagt

SEQ ID NO: 191 - DNA, 2605 bp, Glycine max
  misc_feature (1)..(2605): Glyma.U032300.1
aaattaaaaaaaaataattcaaaagaagagaactacaaaccgacaagctagaggggtggcaaacagaagccaagaaacgccaccgaaagtccaaaacagacaaagtgcggaaaactgttgacagcactctctagaggtgacgtgtttgcaagcaattgccactgtgttgtttcgtttcgtgttcatagcctaagcaaagcaaagataccaaatcaaaatcagaatcagaataagaagaagtcaagaagatgggaatggctgtggcgagtgatgatttgctgagcgagaaagctgcggcgatgagagcgtctctggagagaagccaggccatcacggacgacgtcgtttcgattctcggctccttcgatcaccgcctctccgccctcgaaaccgccatgcgccccacccagatcagaacgcattctattcggaaagcccatgagaatattgataggactttgaagtctgcagaggccatattggctcactttgatcaatattatcaggcagaagcaaaaatagttaaaggaccacatgaagatgtgaagaactatcttgaagcaattgatcagctgagaagaaacattagattttttggcaataagaagggttttaagaatgatgatggtgttgtcatccgtgccaacaatttgataagcgaagctatttctaaactagaagatgaatttaagcggctattatcgtcttacagcaaacctgtggaacctgagcgcctctttggttctcttccaaactcaatgcgaccttcatcagcatcaccaggtcgtgatggtgatcctaatggaaagaatcattcttctaatgtccattatgagctacataaaaataatgtcgatgctcttatatacacacctcctattcttattccaccaagaattttgccactgctcaataatttaacccagcaaatggttcaagctggtcaccaacaacagttgctcaaaacatacagagatacccgttctaaagtattggaagaaagccttcaaaagcttggtgttgagaaactcagcaaagatgatgttcaaaagctacaatgggaggttttggaagccaaaattggaaactggattcatttcatgcgtattgctgtcaaattgttgtttgctgctgaacggaaagtttgtgatcagatatttgaaggatttgactcacttagtgatcagtgttttgctgaagtaactacaaacagtatttccatgctacttagttttggagaagcaattgccaaaagcaagagatcacctgaaaagttatttgtacttttggacatgtacgaaatattgcaagagattcatgcagagattgaaatactctttaaaggcagagcttgcactaaaataagagaagctgtaatgggtttgacaaaacagcttgcacaaacagcccaggagacctttggagattttgaagaagcagttgagaaagatgctacaaagactgcagtaactgatggaactgtccatcctttgacaagctatgtgattaactatgtgaagtttttatttgactatcgatctactttacaccaactttttcaaggaattgaaggtgaaggtgattcttcacagctagcatctgtgacaatgcggatattgcaagctcttcaaaccaatttagatgggaaatcaaaacagtatagagaccctgctttgacacatctatttctcatgaacaatattcattatattgtcagatcagttaggaggtctgaagcaaaggacttgttgggggatgattggatacaacggcataggaagattgtgcaacagcatgccaatcaatacaaaagaaatgcttgggcaaagattcttcagtccctctctattcagggcctcatctcatcaagtggtggtggtagtagtaatgctggtggtgatgcgggcagtagtggtgcttcaagaacaatggttaaagacaggttcaagacattcaatactatgtttgaggaacttcatcagaaacaatctcagtggacagtaccagatgcagagttgcgagagtctcttattcttgcagttgctgaagtcttgctacctgcctatagatcatttgtgaaacgttttgggccactagtggagaatgtaaagagtactcagaggtacatcaaatacactgctgaagatctagagcgaatcttaggtgaattttttgaaggaaaaagcatgaatgataacaagcggtaattggagtcagtcatgtgggaggtaggctagtttgcctctgcatcatggtatttagaggttaataggatctagattttacatttagcacatatggactttttaatgtcttagtttatctcttttgagatgcatatatatgtaatatgggattggtgcccccatcaaacttggtgaggtcaaaggtcataaagttcaaagcagagaggagagggattatatagaaggaaactgttatagtatttagatagaataaaaatatatgtaacaagtgatataaactatatttatattatatagaagaggtaagcatggaagctactggaatgtgatctaacataatcagaaatgatggctaagtatgttacaataaataagccacctaacaaactaacctatgc

SEQ ID NO: 192 - DNA, 1847 bp, Glycine max
  misc_feature (1)..(1847): Glyma.03g235200.1
tctcttctaaagtgaaacttatttttctagtcattatgtaatatacatgcataataaaaaaatcattaatgtgtttgaaatattaatagttaattaattaattttcttgtacactactttattcttttttaagttagtaaaatagatcgtatagcgcactttttattgggcctttaaccggcccacaagctctgtttcagaatattaggaataaaaaaaaaaaaaagctgcgagattacctctccaacaagtttgtgttgtgttgtgtgtgcatgaaaggttgaaccccattttccattgacaattgaactgatggcgagcgccatgttaggggatgctaccacgagctttgaagatggtaagttggcgtctatgaccaccgatgacgtcgtcagagcctctcgtattctcgaaaacgatattcgcattctcaaggaagaggtgcagagatcgaatcgggaatgggaatcgtacaaggagaagatacaagataatgaggagaaagttaaacttaataagcaattgccctacctcgttggtaacattgttgagatattggaaataaatccagaagatgaagcagaagaagatggttccaacattgatcttgactcccaaaggaaaggaaaatgtgttgtgctaaagacatctactcgacagacaatctttcttcctgttgttgggcttgttgaccctgccaagttaaaacctggtgatctggttggtgttaacaaagatagttacttagtcttggatgccctgccttctgagtatgattcacgagttaaggccatggaagttgatgaaaagccaacggaggactacaatgacattggtggtttagagaagcagatccaagaattagttgaagcaattgttttgccaatgacctgcaaggagcggttccaaaaattaggagttcgtccaccgaagggagtgctcttatatggacctccaggaactggaaaaacactaattgcccgtgcttgtgcagcacaaacaaatgccacttttctgaagttggcaggtccacagctggtccagatgtttataggagacggagcaaaacttgtccaggatgcctttcagctggcaaaagagaagtctccatgcattatatttatagatgaaattgatgcaattggaacaaagcgtttcgatagtgaagtaagtggagacagggaggtacagcgaacaatgttagaattgctcaatcagcttgatggttttagtagtgatgaccggattaaggtgattgcagcaacaaaccgtgctgacattcttgatcctgcccttatgcgttctggtcgattggatcgaaaaattgagttcccacacccaactgaagaagcaagagcccgaattctacagatccattctcggaaaatgaatgttcaccccgatgtcaactttgaagaattagctcggtccacagatgatttcaatgcagcacaacttaaagctgtctgtgttgaggctggcatgttggcccttcgccgtgatgcaactgaggtgaaccatgaggactttaatgaaggcatcatccaagtccaagcaaagaagaaagcaagcttgaattattatgcataggcactcaacgcaaggaaaaacgagcattgaagtttgacttgtttgctagattgatcttactcgaatcatatgtaacatacagcttgctaatttaagatcatcttttaaaacagtattctggttgcaaatttcttagatgcagctttatatatgttttatttgcttatgttttgaaattcatcgtgttagaaattttttaatattatctttgatttctgccgataaaaaaaatttcaagttggtcaggttgtgagtat

SEQ ID NO: 193 - DNA, 1537 bp, Glycine max
  misc_feature (1)..(1537): Glyma.09g217700.1
aggctttacgtggcaggtcgaggacgctttcattgccacctatgtcatgcactcccttaaaactcacatcacactcttcctactaccacattacatacattatctttctttgcacgctcttactcgtttcctttgtctttgtctttctctttcggctttttcttctgctccactgtttctatcccttcctttctgtatgcaatgtctttttctctacttagattggcatgcttgtttggtatcagaatcgcattaactgtcatatatacttggacggagttgatcaggacttcaattagcttccatgtaaacataatattaagaatgatcacatggacatttgggcttatctccctgcctgcaagagttgtgaatgcctttcaaagggagaggcagctggaacaaaaactacatgaaatgcacatagagttggagaatctagtgtgggataagaaggaacttcaagaacattttcaaatggctgtcaaagagcgcaaaatgatggagatactactggcagagcttgaagaggagcatgatatggccattgcaaatattgaaaagttagagggaaagttgcgggatcagacaaatgaaaatcttcggctgaaagaaattcaaggaaagggatactggagctccaaagaccacaacaacactgacagagtccaaaccatagatgacagcaactacaacatttctcatcctatactctcactgaactccaactacaacggcagtggaatcacccttcaagatcttctaatgcgcaaagatatttggcaagatgagagcaaaaccagaagtgagttgcttaaactcttgaaagctgtaccaaagtccgggcaagttaagtccgaaatgagggaagcactagaccatcatcgagacatagctctttcacaatcacttttcagtgcccttatgtcacttgtggttggagtcactgcgtgggaagctgaggacccttgcatgcctcttgtggtggctctcttcgccgtagtaggcatgtccttgaagagtgtggtgcagtttttctccaccattagaaataagcctgcatctgatgctgttgctcttttaagcttcaattggtttgttcttggcactctaacctaccctaccttaccaagggttgctcgcatgctgtctccactagcgcaacgccttatggaccaaaccatgatccggtttggtctcctttccttagcttgacactgctttttttcttttctgttgtgttatattattatgtgcagtataatctgaattttgagtcctatttactgtggtgtgcgtttcttactgcttgtaaaatatgatgaggaatctctgtaatttggttgtctgtgatgagatattctgctttctctgtttcaagctcacaaacatgaaaaggagataggaaatcagtttttgttttctttaccatttttcagagttcagtaagagctattattgtttttgttaactttgatcaatgttctgcaggattatttaaggatcgtgcatgtttgatttatttacattgggagag

SEQ ID NO: 194 - DNA, 6268 bp, Glycine max
  misc_feature (1)..(6268): Glyma.15g212800.1
tttggcgttttctctctttggacttcttttgacttcttttcactctgtctcgtattcttcctctctcggcacttgaactgcagcaacctttctctctatcacccccgcgaacaatgctcctcctcctccttcttccagatccagctaatgctccacattgcgcattctctctctaacccctaacccctaaccccgaaacgacgccgtctcgccctcactcccccgcgcaaaaccctagatctgctgcgattgcgactgcgactgcgatgctccacctccgccagcgccgcgacgccgtcgcgccagccaccacgcgctggcgcaacacgttcgaggagaatctggagcagtggccgcacctcaacgagctcgtccattgctacaccacggattgggtcaaggatgagaacaagtacggacactacgactccgtcggaacgccgtcgtttcataaccagatatatgaaggccccgacactgacattgaaaccgaaatgcgccttgctggggcaaggcaaacaaagggtgatgatattagtgaagatgacatacctagtacttcaggaaggcagtttatggaaggtgcagatggtgacttgctgccttcggatgttccaaagcatattggtcaatctctccttcctgcttatgagcctgcatttgattgggaaaatgagagggcattgatatttggacaaaggataccggaaactcctgtattgcatggaatgaagatctctgtaaaagttcagtctttacaatttcaagcaggattggccgagcccttttatggtacaatgtgcttgtacaatagggagagaagagaaaagttatcagaagacttttactttcatgtcttaccaactgaaatgcagaatgccaaaattacatgtgaacctcgtgcagtcttttacttagatgcgccatctgcttcagtttgtttgttaatccagttggagaagcatgctactgaagaaggcggggttactgcttctgtttattcacgtaaagatccagtgcacttgactgagagagagaagcaaaaactgcaggtgtggtctaaaatcatgccttacaaagagtccttcacatggaccatcgtatcattatttgatagcagtattggtgcagcttcagtagggcctgcttccccaagcagccctcttgctccaagtatatctggttcaagttctcatgaaggtgtttttgatactagtgcaaaaatctctttagatggaaagctgagttactccaatggaaattctgtggtagtagaggtttcaaacttaaataaagtcaaagaaagctatactgaggaatcacttcaggatcctaaacgtaagatgcacaaacctatcaaaggtgttttgaggctggaaattgaaaagcaccagatttccctagctgatttggaaaatgtgtcagaaagtggtagtataaccaatgattctgttgaccctggggatcgaattgtggattcactgtctggaaagtatcctagtaatggttgtgatgatcctcagggtagcaacctcagggtagtatctccagttttgggaaatggagcaaatcaacatggaaattcagattttaatgccgatgatttccatgcttttgacttccgcactacaacaagaaacgagccttttttgcaactttttcactgcctgtatgtgtatccgttgactgtaagtttgggtaggaaaaggaatttgtttatacgggttgaactcagggaggatgatggtgatattcgtaggcagccattggaggcaatatatcctagagatccaggtctagatgcatcgtttcagaagtggggtcacacccaagttgctgttggagctagggttgcttgttaccatgatgaaattaaactttcccttcctgctatgtggacaccaatgcaccaccttctatttactctatttcatgttgatctgcaaacaaaattggatgccccaaagccggtggtgattggatatgcagcacttcctttatcttcccatgctcagctgcggtcagaaataaatcttccaattatgagagaattggttcctcattatctccaggatgcagggcgggagagattggattatttggaagatgggaaaagtgtcttcagattgcgtttacgactatgttcttctttataccctatcaatgagcgtattagagatttctttcttgaatatgaccggcatactcttcgaacaagtccaccatggggttctgaacttctggaggctattaatagtttgaagaatgttgattccaccgctttacttcagtttcttcacccaattcttaacatgctacttcatcttattggcaatggcggagaaacactccaggttgctgcctttcgggccatggttaatattgtaaccagggtgcagcaggagtcagttgatgatgctgaaagaaatcatttcctagtcaactatgttgattgtgcttttgatgattttggtggtcgtcaaccacctgtatatcctggactgtccactgtttggggaagcttggcacgaagtaaggccaaagggtatcgtgttggacctgtgtatgatgatgttttggctatggcatggttttttctggagctaattgttaaatcaatggcattggagaagactcgtctcttttatcacagccttccaataggtgaagatatccctccaatgcagttgaaggatggtgtattcagatgtatattgcagttgtatgattgccttcttactgaggtgcatgagcgctgtaagaagggtttaagcttggcaaaacgcctgaacagtagtttggccttcttttgttatgatcttctatccattattgagccacggcaagtttttgagttggtatcattatatcttgacaagttctctggtgtatgtcaatctgtacttcatgaatgcaaacttacctttttacaaataatatgtgatcacgatctttttgtggaaatgcctggaagggacccttcagataggaactacctttcttctgtactaatacaagaactctttgtaacttgggatcatgaagatttgtctctaagagcaaaggcagcaagaattttggtagtgctcttgtgcaaacatgagtttgatgtgagataccagaagcctgaagataaattgtatattgctcagctatatttcccacttgttggacagatattagatgaaatgcctgttttctacaaccttaattctgttgaaaagcgggaagtttcaatagtaattttgcaaatagttcgaaaccttgatgatgcatcacttgtcaaggcatggcagcaaagcattgcccggactagattgtttttcaagctcatggaggaatgcttgcttctttttgagcacaaaaaacctgctgatggcatgttacttggctccagttctcgcaacccagtaggggaggcacctgcttcccctaagtactctgacagactttctcctgcaatcaacaattatctgtctgaggcctcaaggcaggaagtcagacctcagggaacaccagataatggttatttatggcagagagtaaattcccagttaagctcccctagccagccatattccttgagagaagctctagctcaagcacagtcttctaggattggagcttctgctcaagcacttcgagaatctttacatccacttttgaggcagaaattggaactttgggaggaaaatttgagtgcctttatcagtcttcaggttttggaggtgactgagaaattctccatgatggcagcatcccatagcattgccactgattatggaaaacttgattgcataactgctgtgttcatgagctttttatccagaaatcagccgttaactttttggaaagcattttttcctgtatttaacagtgtgtttgatttacatggggcaactttgatggcaagggaaaatgatcgttttctaaagcaagtcactttccatctccttcggcttgcagttttccaaaatgaaaacatcaggcaaagggcagttgtcgggcttcaaatacttgtgaggagttcatttcattactttatgcagacagcaagattgagagtcatgttgattatcacattatcagagctaatgtctgatgtgcaagtgactcagatgagatctgatggaagcttagaagaaagtggtgaagcacggagacttaggaagtctgtagatgaaatgaaggatgaaactaaaaatgcttacttgttgaaggagtgtggtttacctgagaatgctcttgtgactgtaccagaaaaaatgacagaaaatagatggtcctggtctgaggtgaaatatctctctgacagccttcttttggcccttgatggcagcttggagcatgcactattggcccccatgatgactatggatagatatgctgctgctgaaagcttctataaactggccatggcatttgccccagtccctgatcttcacataatgtggttgcttcatctatgtgatgcacatcaggaaatgcagtcatgggcagaagctgctcagtgtgctgttgctgttgctggtgttgtaatgcaggcccttgttgccagaaacgatggtgtttggagcaaagaccacgtttctgctttacggaagatttgtcctatggttagcaatgagattacgtctgaagcatctgctgcggaggttgagggatatggtgcttcaaaactgactgttgactcggctgtgaaatacttgcagcttgctaataagctcttctcgcaagctgagctttttcatttctgtgcaagcattctggaacttgtaatcccagtttacaaaagcaggagggcttatggacagttggctaaatgtcacacattacttactaatatctatgaatcaattcttgaacaggaatctagtccaattcctttcacaaatgcaacgtactacagggttggattttatggtgttagatttgggaaacttgataaaaaggagtatgtatatcgtgagcctcgtgatgtacgtctaggtgacataatggaaaaacttagtcacacatacgagtctagaatggatggtaatcacactttgcatattattccagattctagacaagtgaaggcagaggagttgcagcctggtgtctgttaccttcagattactgccgttgatccagtaatggaagatgaggatttaggaagtaggagagaaagaattttctctctctctactggaagcgtccgagcccgcgtatttgaccgattcttgtttgacaccccatttaccaaaaatggcaagactcaaggtggattggaagatcaatggaagagacgcactgttcttcggactgagggttcttttcctgcattagtaaataggttattggtaatcaaatccgagtcccttgagttctctcctgtagaaaatgcaatcggaatgattgaaacacgaaccgctgccttaagaaatgagcttgaagagcctcgaagttcagagggggatcaacttccaagactccagagtctacaaagaatcctacaaggcagtgttgcagtacaagtgaatagtggagtcttgagtgtctgcactgccttcttgtccggggagcctgcgaccaggttacgatcacaggaactgcagcaacttatagctgcccttcttgagttcatggctgtttgtaaacgtgccatccgtgtacatttcagattgattggtgaggaagatcaggatttccacacacaacttgtaaatggtttccagtcactgacagcagagttatcacattacattcctgccattctctcagagctatgacaagtgtttgcctcttaatattttgcttcgatttgttcatattgtagtctcctcattccctttcaccctctttctatcgcttgcaaagatgtgtaattgaatttgcatcatggttcgtatacttagaattatgcgaaccaggtgattcaggaaaaacacgaatcgtcctgtttgtgtatcatgatgtttctagtttccccactttcccctttttagtttgtggtgcggggaatgtcatttgtgtaatattttaattgtttaagttgtttagccatacagctattgtgaatgattactatgtagtataccttagaattctgcattttagggcgtttgtgtagtggagtggattaagtgtaactgacagttaaataaatacatgaaaaactattagtaattcttggtaaatgattgtaagtataaacctaaatatatttacaattgataaatatttcatgcatttaacaagtcagggaaatcttatgcaattgagc

SEQ ID NO: 195 - DNA, 2245 bp, Glycine max
  misc_feature (1)..(2245): Glyma.11g158400.1
ttcgttgtgtcacactaacactcatcactcggaggatgtttgtgttgggtgtttcttcctcctccttcgccgccgccgccgcctccgccgctgcaaccaccaccacctccactcaccaccttctctgtggaacccttcactctgcttctttcctctcaactacccatccctttcccacaacttcgttgcggtcatcttcactgcacttcaggtgtgttcccatcagagccatggctgagattgatactatatcagtgtcaaaatctgcttcttcttctgctccaggcagcaagcaagccttgatatcattgtcagacaagaagggtcttgcatttgttgggaatgggctccaggaattaggatactctattgtttcaactggaggaacagcttctgcattagagagtgctggagtagctgttactaaagttgaacagcttactaagttccctgaaatgcttgatggtcgcgtcaaaactttgcaccctaacatacatgggggtatcctggctcgaagggaccaaaaacatcatatcgaagccctcagtactcatgggattggtacttttgatgttgtggtggtgaacctgtacccattttacgataaagtcacatcagctgggggcattgaatttgaggatggaattgaaaatgttgacattggtggtccagccatgattagagctgctgcaaagaaccacaaggatgttttgatagtggttgatacagaagactaccctgcccttctggaatttcttaaaggaaaccaggatgatataaagttcaggctaaagcttgcatggaaagcttttcaacatgttgcttcctatgactcagcagtatctgagtggttgtggaaacagagtgtgggagataaattccctcctagcttgacagtgcccctctctctcaaaagtcctctccgttatggtgaaaatcctcatcaaaaagctgcattctatgttgacaaaagcctttctgaagttaatgctggtggaattgctacagccatccaacaccatggaaaggagatgtcatataataactacttggatgctgatgctgcttggaactgtgtatgcgagtttaggaaacccacgtgtgtagtagtaaagcatactaatccatgtggggtagcatcacgtgatgatattcttgaagcctacagactagctgttaaagctgatcccgtgagtgcatttggtggaattgtagctttcaatgtggaaattgatgaggcacttgctaaagaaattcgagaatttagaagccccacagatggggagacaaggatgttttatgaaatagtggttgcgcccagctatacagagaagggacttgagattctctgtggaaagtctaagactctaaggattcttgaagcgaaaaagaatgaagctggaaagctttcactcagacaagttggtggaggatggttagctcaggattcagatgacttaaccccacaggacatcaagttcaacgtagtctctgagaaggctccacaggatgatgagctttgtgatgcggagttcgcatggttgtgtgtgaagcatgtcaaaagcaatgctattgtgatagctaagaacaattgcatgttaggtatgggaagtgggcaaccaaaccgtgtcgagagtttgagaattgcaataaggaaagctggagatgatgttaaaggagcagccttggtcagtgatgccttcttcccatttgcatggaaagatgctgtggaagaagcatgtgagagcggaatcggtgttattgcagaaccaggtgggagtatcagagaccaggatgccatagactgttgtaacaagtatggtgtttcactactctttaccaatgtgaggcactttaggcactaacctagttttttgcttcggaataacttcatgcttccatcattcaagcggtgttactgaaacttgtgcttccaataggtagcactgaaacctgtttttgaaatcaagtgactgtatgagtaagattgtactatccaatttatatagaaaaataaaaattgatgttctgctactttctaatgtcttatgtacattagaataatgtgatggagtaatcttttgcaatgaacagaatcaaattagacatttttgctgtaactattcaattatgctcagttggaagaaaaaaaacatgtaaggattttgaatgtgagaaagtctttgcttagattctgtttggatatgtttctcataagtgcttataagagaataaaacaagaagg

SEQ ID NO: 196 - DNA, 1768 bp, Glycine max
  misc_feature (1)..(1768): Glyma.18g047900.1
aatcttgtcactgtttctgatacttaacgcaacacatcaccgaacactacccactcaactcactccaaccatggcgtcgtggtggtgctcctctccctccgccaccctcaccgtctccaccaccaccacccgccacttctctctcctttctcacacttcccaatttcgcatccaaaccctcacattcccaccttcctcctttactcgcttcaccaccgctccaccttcgctccgatttagggttccatgctccaacaaaaccgccttcgaaaccgagcttccggaggacggcgtggattgcgtgggaacaggccaagacgtggaatgcctcgttaacacggaagagaaacaatcggaaccatcatcatcgtcatcatcatcatcatcatcgtcatcgatgctgtgtctcgcggaagcgctgtgggaaggggcggtgttggtgtcgccgttcttcttctggggcacggccatggtggcgatgaaggaagtgcttcccaaatgcggtcctttcttcgtttccgcttttcgcctcattccggcggggtttcttctcgtcgcattcgccgcttccagaggaagaactctcccctctggcttcaacgcttggctttccatcaccctcttcgctctcgtcgatgccgcgtgctttcagggttttcttgcagaagggttgcaaaggacttcagctggtttgggcagcgttataattgattcgcagcctttgactgtggctgtacttgcggctttgttatttggtgagtcaatcggagttgttggagctgctgggcttgtacttggtgtcataggacttgtactgctcgagttacctgccctatcatttgatgaaagcaacttctcactatggggaagtggtgagtggtggatgctacttgcagctcagagtatggcaattggcacggtcatggtccggtgggtctccaagtactctgaccctgtcatggctactggatggcatatggttattggtggtctcccacttgtgctattcgcagttcttaacaatgaccccgcagtgagtttgagtctcaaagagtacagttcgactgatatattggcactcctctacacatccatttttggaagcgcagtcagctatggtgtgttcttttatagtgcaactaaaggtagcttgaccaagctcagttcacttacgtttttgaccccaatgtttgcttcaatttttgggtttctctatcttggtgagaccttctctcctgtacaactagttggggccttagtcactgtggctggaatatacatggttaacttcagaagcacatctgaatgaattgtcatttttgcctggttctttcaacctaatccaatggaaaacaactctgggaattagatgttttccatgaactcaaattgggaacgataaaagcaagtttggacatggagaggagaaattgcagtgatatacaacttggagcccttgtgctcatgctagtgtaaatacaattttgttttgttagttaatttaggcctcgagcctcttcctatgcaatatataccaaaaacttgaagttacctgggcagaacacaagccttatatcggaataaattgtttccgtaaaggtttttttgttgtataaaatggcttaagtgattatgactgaacaaaatgtatatattatgactgttgatggcaagtttcgagtataatgaatctgttgtgaaagaaatatacagatcgggccgatgtctatattgagcataagatcaagaaggaagttctatacttgtc

SEQ ID NO: 197 - DNA, 2537 bp, Glycine max
  misc_feature (1)..(2537): Glyma.07g197000.1
tgccatttttccatcccacgtcaaaatcagcgaggcacgagtgtcttaagagccaaatattgtgcttgtgcgcactattcacaaatttacatgttctcatttttattccccagtaaggtaatttccccctcatataaataacattcaatgaaaatttcctgagtctgactctgagatcatcatcctcacttccggatcagcggaatcaataaactataatttctttaccacttaaaatttgcaatcttggatttcagaaaactctacggggccaatcataaaccctagattcatagaggggggattttgttttttcagtgtaatataaccgtatttcagttgatttttctgttatttggggatctggaatacccagaaagagaaatcaactttgttttgttgttaatttgttgagtttggagtgagagagggattggtgagagtgcattgggaattggtgtgatctgggggtggagggagagaaagagaagggggtgaggaatgagaggaggggcataaatgtctgctccattgggtattggaattcgttctggaagttatgggtctttggataaacaggtacagaacgggactgcacgcaaggcttcgaagatgctcaaggagaaggagaaggagaggctgttcctttggatctgcaagttcgccggccgcaagaaggtcggaatgctcttcctttgcctcatctccgccgcggttttcgtctgggttttgtatgttggaaaaggtgaagattctcaggacggaaacactgtgacaaacattaatgttaatgaaagtgtgtctacaagtgattctacatttgagaactctatgacaaatgcaatgggcttaactaagagattggtattactccctccacccacgggttattttttgggctaccatcttcctccagggcatccgtgtaatagcttcacactccctcccccgcctgctgataaaaagcgtactgggccacgtccatgcccagtgtgttaccttcctgtggaagaagccattggactgatgccagcattgccctcaccttcaccggtccttgggaatttaacatatgtctatgaagaaaatttaagtagagatggagaatttggtggttcagactttggtgggtatcctactttgaagcagagaaatgattcttttgatatacgagagtcgatgactgtgcactgtggatttgttagaggaattaaacctggccgcaacacaggatttgacattgatggagctgacctttttgaaatggagcagtgtgatggagtggttgttgcatcagccatatttggaaactttgatgtgataaatgagccaaacaatataagtgattattcaaggaagactgtatgcttccttatgtttgtagatgaacaaacagaaaaatatctgattagttctggtaaattgggaatcagcaagaagattggtttatggagaactattgttgctcgtaatcttccttaccctgatgcaagacggacaggaaagattccaaagcttttgttgcatagattggttccgaatgctcgctattctatatggcttgatgggaagcttgagcttgttgtggatccatatcaaattcttgaaaggtttttgtggagaaagaatgctacttttgccatatcaaaacattatagacgctttgatgtattcattgaggctgaggcaaataaagctgctggaaagtatgataatgcctctattgactttcagatagagttttacaagaaagagggattgaccccatatacagaggctaagcttcctcttataagtgatgttcctgaaggatgtgtgatagtacgagagcatgttcctattagcaacctctttgcttgtctttggttcaatgaagttgaccgatttacttcaagggaccagattagtttctcaaccgttagggacaaaattttgtcgagggtagattttcattttaacatgttcttggattgtgaaagacgcaactttgtagttcagaaataccacagggatctattgttgcgcctggcgccaccagcttcaccccctcccccatctcctcctcctccattgccagtgcttgaaacatcacctgaaaagggtgcaaactcacccattagaagaggccctggaaggcgtggaaaagatcgacgagctggttcacggcgccaccgcaaagttgttgctggaggtagagagatggaaccaagttaacaattttgtttgggtgattatattattagtagttttgtttaaaattccacctacagaaatcattcgttgcagagctggagggaaaaaatgtgcaagatgagtgttgtattgtttccacatagacgctctcattcttttaactatccgcaattgtccatttttgttaattttttgctgtatatatagtaaagttttcaataattatagtggtaacccattttgctattccgctatcactaaattcctcacagaaaaagtgtacttcctctgttatactactctaaagatatattcaagactcgttcattcgtattgatagaagt

SEQ ID NO: 198 - DNA, 3211 bp, Glycine max
  misc_feature (1)..(3211): Glyma.17g089100.1
gaccgtgaactaacgctggtacataaaaaactcaaagcaaaacaaaaccctaaaccctaaccaacactgtcttcgaatcacagtagcggcaatttgcccaatggagcccctacgattgaagaccaactaccgctgcgtccccgctctgcagcagttctacactggcggccccttcgtcgtctcatcggactcctccttcatcgcctgcgcctgcggcgagtccatcaagatcgtcgattcagccactgccgccatacgctccaccctcgatgccgactctgaatccttcaccgccttggctctcagccccgacgaccgcctcctcttctcctccggccactcccgccaaatcagagtctgggacttgtccacgcttaagtgcgtccgctcctggaagggtcacgagggtccggttatgtgcatgacgtgtcacccttctggagggttgcttgctactggtggagcagataggaaggttctagtgtgggatgtggatggtggttactgcactcactactttaaaggtcacggtggtgttgtttcttgtgttatgttccattccgatcctgagaagcagcttcttttttctggcagtgatgatggtggtgatcatgcaactgtaagggtttgggatatttccaagaccaagaaaaagaactgcattgcaacactagataatcatagctcagcagtgacttctttggcattatctgaagacggatggacactgcttagtgctggaagagataaggttgtaacattgtgggatcttcatggttatagtggcaagaagactgtcattacaaatgaggcagttgaagctgtttgtgtaattggtgctgggagtccttttgcttcatctctcgatttatatcagcaaaatgcaaaaatacatgatggttccgaaatattctatttcattacagttggtgaaagaggcattgtacgcatatggaattccaaaggtgcaggttgcatctttgagcaaaaaacttcagatgttacagccggcatggatgaggatggctcacgtaggggtttcacttctgctgttatgcttgcctcagatcaaggattgctttgtgtaactgcagatcagcagtttctgttttactctctggacttcactgaacagttgttgcaattaaatctaaccaaaagacttgtgggatataatgaagagattgtagatatgaagtttattggggatgatgaaaaattccttgctcttgctacaaatcttgaacagattcgggtttatgacctttcatctatgtcatgttcgtatgtcttatctggtcacactgaaattgttctatgccttgactcctgtgtatcaagttctgggaaaccactgattgttactggaagtaaagacaacagtgttaggttatgggaaccagaaagtgcaaactgcattggagttggtataggtcacatgggagctgttggagccattgccttttcaaaaagaaagcgagatttctttgttagtggcagtagtgatcatactcttaaggtgtggagtatggatggtctcttggacaatatgacagtgccaattaatttaaaagcaaaagctgttgttgcagctcatgataaagatataaattctgtagctgttgctccaaatgatagtttagtatgtagtggttctcaggatcgtacagcttgtgtttggagacttccagatctagtatctgtagttgtatttaaaggtcataaaagaggaatttggtcagtagaattttctcctgttgatcaatgtgtagtaacagcatctggtgataagacaataaggatatgggctatatctgatggctcctgtttgaagacatttgaaggacacacttcaagtgtgttaagagcattgtttgttactcgtggaacacaaattgtttcttgtggtgctgatggcttagtaaagctgtggactgtaaaaactaatgaatgtgttgctacttatgatcatcatgaagacaaggtttgggccttggctgtaggcaggaaaacagaaaagcttgcaacgggtggcggagatgctgttgtcaatttatggtttgactccactgcagctgacaaagaagaggctttccgtaaagaggaagagggagttgtgaaaggtcaagagctagagaatgctgtctcagatgctgactatactaaagcaatccaaattgcatttgaactgcgcaggcctcataggctttttgagctatttgcagaactttgcaggaagagagaggctgaagatcatatggacagagcacttaagggcttggatagtgaagaacttcgtatattatttaactatgttcgagaatggaatacaaaaccaaagctttgttatgtttctcagttcgtgcttttcagagttttctgcatctttcctccaacagatattgttcagattaaagggattggtgaatatcttgaaggtcttatcccgtatagtcaaaggcattttggcaggatagatagacttgttagaagcacatttttgttagactacattctatcaggaatgtctgttattgaaccacaagctcaactgacagaatcaaagactgagttactgttgcagtctgaaattggcattccagatccggacaaagaaaatgacactaatgaaattaccgcttcaaagaaaaggaaatcaaacaaatcaaaacatggttcccataagaaagttaagaatgtagcttacaacaaggtcgaatctatacaattacaggcataggattggtgctttcatcgtcttctcatgtatacatatgttggttgatcgatggaagagctgttttgattcatccaaattttgaaatcttgctgtcatttgataaaatgtaagccgaagtattgctgtcaattaagaagatgtaagcatagccagccactgtaattgtatcagtatttattctttcatgtaggttggttttcctgtcctgctcatcacgtggtatagaaatgtttcttcagctgtcttaacaaaagaaagttattgtgagagacgctgaggcgctgcaaagatagcatgaaaaggcaatcgtagtaattttgatccacataattcttattatgatcaattgtcaattccttgttctctaacttccttttggtttgtcttagctttcaaatataagcaaaatccgtatatttcaaaagggtgtaatattatttttcttctgttctgaatgtgttgtgcgtgttc

SEQ ID NO: 199 - DNA, 2760 bp, Glycine max
  misc_feature (1)..(2760): Glyma.03g140100.1
ttgttgtccatccccgactctgtctacaatttcttttgggtaagttaaccctctcttctactttacctgagtctaccctctcttctctctctctctctctctaattcagtcttctgaggaggtagtttactgtcataattgtggaatgtagctttactcatctttcatgtgaaaacccttcatatggttgctgcaacccattgaatagtccccgaaattcattctcttagtatacttttactttgcccaattaatgcccttcagcctacagcgtgtgtcttcaatcacagcatttggatgaaaaaaaagggtagagagggttggtagtagaattcacattcacacatacttcgccataaagaatctattttttctctccttttctttttactctcttaagttcgtagtagcaaatcaggatttgctgcttcagtgcttcttcaccctttgtcttctagcctctggaatttttccatggagatagagaacggtgacaccaggtccaaaaagatggaagagtatcaagtcatagagcaaattggaagaggagcttttggctctgccttcctcgttcttcacaagtccgagaaaaagaggtatgtgctgaaaaaaattcggttggccaagcagacagagaagttcaaacgtacagcattccaagagatggacctgattgccaaactgaataacccatatattgtggagtacaaagatgcttgggtggagaaggaggaccacatatgcattataactggctattgtgaaggaggtgacatggcagagaacataaagaaagctcgaggttcattttttcctgaagagaaagtctgcaaatggctgactcagttgttgatagctgtagactacttgcactctaatcgtgtaatccacagagatcttaagtgttccaacatattcctcaccaaagacaacaacattcggcttggtgactttggtcttgctaagcgacttaatgcagaagatcttgcttcctcggttgttggaactccaaattacatgtgtcctgagctccttgcagatataccttatgggtataaatctgatatgtggtctcttggttgctgcatgtttgagattgctgcacatcaaccagcatttcgcgctccagacatggctggacttatcaataaaataaacagatcctccatttctccactgccaattgtttattcttccacactgaaacaacttatcaaaagcatgcttaggaaaaacccagaacataggccaactgcagctgaattgttaaggcatccgcttttacagccttatgttcttcgctgtcataatgcatcatctaatgttcttccagtatatcccttagttaatccaaaggataaaacaagaagatctaataaatctagtggtggcaaggaccataaggacaaagaagctagtttggtaaatcgtttggagcggattcatccaattgagggaaatggagatatacagataagcaatcttcctaatgatgcggtaacaatctcaaccagtgcagaagacaatctagagaccaggatggctgatcttaccagctacatagtggaatcttgtactagtattagtggctcaaaagatgggtcaacaacatctgaatcaactatttgcagtgtgtgcaaggaggactttaaaagtagacctgcaagggaaacggctaacaatgagatctcttctaagagtacacaaaattctatgcatgaaaaacaaagatttgctgctaaacattttcataaattagaagaagacaacataaatgtggcgaccacagaagttgaagatgcttcttgcaatgaaggtttggatagtgctgaagcacagagggaagattcgaactttgaggactcaggtaaatccacaatgtccagtgcaggcagtagcactgataaagataagtccatcaatgaggaaagttcatcactgattatgcatcctattagggttgaacatgacactgaatctggaaaccactcgaagaaaagcaaaacccctgatgtatttacagaagtctctcatatgaactgcttgacatcttttagtaatgatgcacttccagttaaggatgatgacatggcaaacgtacacattctttgctccacgcataaagaagatgataatgcggtggaggttgatcaggcaccaagaggtgtttcattgagtgtaataactgaagtagatggtgatgaaacaatcaagactccggtggatagtccctgccagcaaagagcggatgctctggaatctctgctcgaattatgtgctcagctactcaagcaagataaactcgatgagcttgctggggtgctaagaccatttgggaaagaagctgtctcatcaagagaaacagcaatatggctggcaaaaagcctcatgtctgcccaaaagtttaatgctgaagcctaagttctggccataaatttatacattgttgtaagaaatgtgcatttcaaatgtcacatgagttcctttcgagatttgttgcttggttgaagatgggagactggaagatagcatgccacatgttctttcttggttgtcgtaaatggttacagtaaatgaattaaattatttttgttaggttggatagtcatttgtgcttgttttccagcagtgtatgggccactgattgtgtatattttcttacttccccttttccgaactaaacaataaccatgcacttggagcttgatattttattcatttggtttatttgttagaagacattctcatgaccatattaac

SEQ ID NO: 200 - DNA, 2270 bp, Glycine max
  misc_feature (1)..(2270): Glyma.18g131200.1
tttatgcaagatatccctggcagcacggtacatcgaattacggagtcagtcgtggttggcctccagctagctccgttgtttgactgaagaatcaccatctagtcatgacacggcagaaatagaattcaggtttgaagtcaacgaagaattcacaaccacgacgccctgcatcgccacgtgcccctctgggtcccacctcgaaaccacaataatccccaaaattctatcctctcccttttcccgattcggaaccaaacaaagccctagcatgaaatcatccttcgaagaaaaataattccaatcaatcctagaatccaatccctcccctttgaatttgatgcctcctcgcattcaattccacgctctggtggcatcatcatcatggatcgtggtaataacaacaataacggcgttgttgttgttgtcgtttgggtgcgaacggggacacgctctgaaggtgccgtttagagtaaacgacgtgctccccgtgctgccgcgcgagatctcgtggccggttctgaacaacctgcacagcgccgtcgacctgctcccttatttcgttgggtccctcactcctgccaatgcctccgtcaagtggaaaggggcatgcttcttcgataacaccgccaagattgagttcgcaccctctttggagggtgccactctctatctcaagacagaggctgcacatagctggacctgcatggatttgtatgtttttgcaacaccctacaggattacttgggactactacttctcttcacgagaacataccttgaagtttgactcgtgggaagagcctgcagagttggaatatgtgaagcagcatggggtttctgtgtttctcatgccatccgggatgcttggaactctgctttctctgattgatgttttgcctttgttctcgaacactggttggggtcagaaagccaacctggattttctgaagaaacacatgggagctacatttgagaagcgcagccagccttggcgtgcatatatagatcctgcagatgttcattcaggagacttcttagctgtgtcgaagatccggggtaggtggggaggttttgagacgctagaaaagtgggttactggttcattcgctggtcatactgcggtttgcttgaaggatgaatggggcaatttatgggttggtgaatcagggcacgagaatgaaaagggtgaagaaataatagtggtaattccctgggaagaatggtgggaattggctcttaaggatgattccaatccacagatagccttacttcccctgcatccagaaatacgagcaaaatttaactccactgcagcatgggaatatgcccggagcatgtctggcaagccatatggttatcacaatatgatattcagttggattgacactgtagcagacaactatcctccacctcttgatgctcacttggtaatttctgtcatgtctatgtggactagattgcagccagcttattcggcaaatatgtggaatgaagcattgaataagcggttagggactgagggtttggatttgcatgatattttagtagagactgagaagcgtgggataccttttgatgaattactcaccattccagaacaagatgaatgggtatacagtgatggaaagtcgacaacttgtgttgcctttatcctttctatgtataaagaggctgaagtttttggtcccattgctaattccattcaagtaaccgagttcaccattcgcgatgcatacatgctcagaattttcgaggacaaccaaacacgcctaccaagttggtgcaacaatgagaatgaccggattccattctgtcagattcttggtgaatacaagatggaactgcctggctataacaccttggagccatatgccaacatgaatgagtattgcccttctcttcctccaacttatgataggccttctcgatgttagatccatcttcttccatcgtttctatcattttgaattgcctgttaaatttaacttaaggcatcaagtactttggtgttctaaaattgtctataaaccattcaacacggcattgtgtatctacagcttgatggtcaactataaaaaaaaacacagtacaagattgatatttaattagcatgaaggtaagctaactgcttgaataatcgtcattatatgagctacaaagttcatatggtgatgttgagtggtttggccttaatctaaactgactttgatgaaaacatgaccacagaaaatcatattgagagttggatttgctcaaaacttgaaatcatgc

SEQ ID NO: 201 - DNA, 2772 bp, Glycine max
  misc_feature (1)..(2772): Glyma.05g044200.1
ttctcttttcggagcctttctatttcgttctcatccatttctcttctcgcgtctcactctcccaccgattcagtttcggacactcactcccactcgctccgattaccgcaccattctgcgtcgccatttagggtttcttcgctcctctttgttggatcttcctcactttgcatcgttctcttcgattcgtaaaatttttcttgcttctcctgtcttggctcgagatccgggccaagcacagaagaatccgtttctgatttgcattttgtactcactggtttggcttgtttttttctctttgtataaatggcttcgagcgaggggtttctgaccgatggccagagggaactgctaaaaattgcaagtcaaaatgcggagaatctgtcttcgtcgccgaagtctcagtcgtccttgctgtctgaccatcatgtgaaagcccctgctggtggtaaggcacaaaccgctggaatagctgtgaggcatgtgcgtcggtcacactcgggaaagtatgggaaggtgaagaaggatggtgctggtggtaagggtacttggggaaaattgcttgatacagatattgtttctcacatagaccggcatgatccaaattatgacagtggcgaggaaccctatcagctggttggaactactgtcactgaccccttggatgaattcaagaaagcagtggtatccatcatagaggaatatttcagtaatggagatgtggaattggcttcatctgacctcaaagaacttggctcatgtgaatactatccttacttcattaagcgccttgtgtccgtggcaatggacagacacgataaggagaaagaaatggcttctgttctgctttcagcactttatgctgatgtcatcagccctgcacagattagggatgggttttttatacttcttgaatctgctgatgatcttgctgtggatatactggatgcagttgacatccttgcattattcttagctcgagctgttgttgatgacattcttcctccagcctttcttgccagggctaagaaggctcttccagaatcttccaagggagttcaggtaatccagactgctgaaaagagttatctctcagctccacaccatgcagaacttgtggaaaggcgatggggtggtagcactcacataaccgttgaagaagtgaagaagaagatagctgatttacttagagaatatgtggatagtggtgacacattggaagcctgtaggtgtatacgtgagttgggggtttcattcttccatcatgaggttgttaagagggctctgatacttgccatggagatacgttccgcagaacctccaatgttgaagctattaaaagaagcagcagaagaaggactggttagttccagccaaatggtgaaagggttttctcgtttggcagaatccctagatgatcttgctcttgatattccatcagctaaggcattgtttcagtcatttgtccccaaggcaatatctgaaggatggcttgatgcttcacttaccaaacctgcaactgaagatggggaaatccaagaagatgagaaggtgaggaagtacaaaaaggaatctgtaactataattcatgagtattttctttctgatgacattcctgaactgattcaaagtcttgaagatcttggagcacctgagtataacccaatatttttgaagaagcttatcactcttgctatggaccgaaagaacagagaaaaggaaatggcatctgtactgctatctgctcttcatatagagatcttctcaacagaggatatagttaatggttttgtcatgcttctggaaagtgctgaagatacagcactggatatattggatgcttcaaatgagctggctctgttcttagctcgggctgttattgacgatgtattggccccactgaatttggaagaaattggctgcaggttaccaccaaaatgcagtggtagtgaaactgtgcgtatggctcggtcactcattgctgctcgtcatgctggtgagaggctattgagatgctggggtggaggcactggatgggctgtggaggatgccaaggacaagatcatgaagctcttggaagagtatgaaagtggcggggttgtgagtgaagcttgccaatgcatccgtgacctgggaatgcctttctttaaccatgaagtagtgaagaaagctttgattatggccatggagaaaaagaatgatcgtatgctagatctactgcaggagtgcttcagtgaaggcctgatcaccattaatcagatgactaaaggcttcacccgaataaaggatggacttgatgatctggctctggacattccaaacgcaaaggagaaatttggcttctatgtggagcatgctcagtcgaatggctggcttctaccctcatttgattcacctgccacagatgcctaattacccccggcagcagctttttgaggacgtttgtgtcttattgtttctctcatgtgtgttgtcctttagctcccaccgaatggtgaatatggataatggataaatctggcttctaatgatccttttatttttttgttccttttacttactcttttttccctgaatcatctcaccgacagagtttcctgttatctcagccattgtataaagttaagttggtcgcattccattaacagctttttaggatgttgtattgcaccaagaggtatttcagaagggcatatattgtatttttcagtatcgactcgtttttcattttgtcaaatcttcggctatggcatcgtggctgtttctttgttc

SEQ ID NO: 202 - DNA, 1987 bp, Glycine max
  misc_feature (1)..(1987): Glyma.02g273400.1
cagtggttcacgttttttgccgaacactgtctactatatctatatgtctaagtcatcttatgctttactttaatatcagattaaccaagtcaagtttatacctagagctagctccaatggcagcagggaagaaggggcacatcgtgatgatacctttcatggcacaaggccacatcatcccattcctcgcattagcaaggcaaatccaacagagaacaacaagcttcaccatcaccatagccaacacacccctcaacattcaatacctacgatcttcactttcttctcccaatgaaatccatcttgctgagttacccttcaactccacccaacacggtttgccacccaacatagagaacaccgagaagctccctctcactcacatagcaaaactcttcctttcaacactcagcctcgaagctcctcttcgctccttgatatcacagatcacagaacaagagggtcaccctccactttgcattatatctgacgtgttccttggctgggttaacaacgttgcaaagactttaggtattaggaacctaagcttcaccacttgtggtgcttatggaactttggcctatatttctatctggtccaacctacctcataggaaaacagactctgatgagttccatgttccggggttccctcaaaactacaaattccaccgcacccaattgcataaatttctaagagcagctgatggcactgatgagtggtcacagtttttcattccacagattgcactttctatcaagtctgatgggtggatttgcaacacggttgaggagattgagcctttggggttgcatcttctgaggaactatcttcaacttcccgtttggaatgtggggcctctcttgccacctgtttcactcagtggctctaaacatcgtgcaggaaaggaacctggcatagcccttgaagcatgtatggagtggctggatttgaaagatgagaattctgttgtctacatttcatttgggtcacagaacactatcagtgcctcccaaatgatggcattggcggaggggttggaagagagtgggatatcgtttatttgggttataaggccaccttttggttttgacattaatagagagttcattgcagaatggttgccaaaagggtttgaagagagaatgagggacaccaaacgtggccttttggtgaacaaatggggaccccagttggagattctgtcacacagttccacaggagcatttctaagccattgtggatggaactctgtgttggagagtctcagctatggggtgcctatgattgggtggccactagctgctgaacaagcatacaatgtgaagatgttggtggaggaaatgggtgtggctattgagctcactcgaactgtggaaactgtgatctctggggagcaggttaagaaggttatagaaatagctatggagcaagaagggaagggaaaggagatgaaggagaaggcgaatgagattgcagctcacatgagagaggccataacagagaaaggtaaagaaaaggggtcttctgtgagagcaatggatgatcttgttacaaccattttatcacccaacaaggctgtatgatttgctacatttagaatttggaatttgaataataataaagttgcttgtgtaagcatacttttgaaactgctaagcaatctttaacacttgactttgatcatgtcactgtggagatcaaaagttcactttttttgattgatgattttaaaacaatatagatggtcaatggatattatgtccatatgttaactttttagtaggactatatgtgcacttgcagagactgtgtcggtctttatacacataaaaatggttttaaagagttaatatatattaaattcattcgtatgtaatttatggttattattatgtattaaaacttcgcatagcgaaaagcctctggacaatgggataggaagtttttttattatgtattaaaacttgtttttcattgaaaatgt

SEQ ID NO: 203 - DNA, 1599 bp, Glycine max
  misc_feature (1)..(1599): Glyma.04g191100.1
ctttctctcacacttgacaaagaggaggcaccatgacaagcactcttctgtctttgctcttcttgctcttctctcttctcactccaactctaatttcctcttcaccagttctaaaccctcaagaggtcgtacaagaggtcaacaagaaaatcaatggctctatagcaagacccagaaggaacttgggctacctctcatgtggtagtggcaaccccatcgatgattgttggaggtgtgaccccaactgggagcagaacaggcagaggctagcagactgcgcaatcgggttcggcaagaacgccattggcggcagagacggcaagatctatgtggtggaggacgacggcgacgacgacgcggtgaacccgaagccgggaaccctccggcacgccgtgatccaagacgagcccttatggataatcttcgccagagacatggtgatccaacttaaagaagagcttctcatgaactccttcaagaccatcgacggaagaggtgccagcgtgcacgttgctgggggtccatgcataacgatacagtacgtgaccaacgtcatcatccatgggattcacatacacgattgcaagcagggagggaacgctatggtgcgggactccccacggcactacggctggagaaccgtatcggacggtgacggcgtgtccatcttcggagggagccacgtgtgggttgaccattgctcgctgtctaactgcaacgacgggttgatcgacgccatccatggctccaccgctattaccatttctaataactacatgacccatcatgataaggtcatgttgttgggtcacagcgattcttacacccaggacaaggacatgcaagtcactattgctttcaaccactttggtgaaggccttgttcaaaggatgccaaggtgtaggcttgggtatttccatgtggtgaacaatgattatactcactgggaaatgtatgccattggtggaagtgccaatccaaccatcaactgccaaggcaacagatttgttgcacccgatgacagattcagcaaagaggtgacaaaacgtgaagataccccagagagtgagtggcaggattggaattggaggtcagaaggggacttgttagtaaacggtgcctttttcacagcatcgggtgctggagcctcctctagctatgcaagggcttctagcttaagtgcaagaccatcttcccttgttggttccataacaacaggtgctggtgcactcagttgtaagaaaggttctccttgctgaaaaacaatgacttctcttctggctgattcattctttccaaaaaggaaaccaaaatatatacatatgttccaaaagaaaagggagggaaattgaaaaagaaaaggaatatatatatagtggatctttagctttgtatttacttttccttgcatttccatatatctccactctttttccctttttgggggtttcttagattgttttctgctgtttgtcttttcttttgtcaattttgagttgctcatgattacaacctccacctgttactcttggaacctagtcagttgaagaatctcgacttctaagagaaaaaaaacaagtgcagaagagttgatattat

SEQ ID NO: 204 - DNA, 5403 bp, Glycine max
  misc_feature (1)..(5403): Glyma.10g209600.1
acgaaaaccaccgttctctttctctctccaaaaattatacggtgggtttgaacttcgaactatgaagggcgaaatcatgcacagtaccatgcagttacagggtttttgaaaatctcaatggacactaccgctgcacgtgattgagtagaattagcctcctgctccaacttgcattgctgtttcaaatcttcaattttccttttttattttttactttcatgtaatgggtagtgttgaaatccccaattggctgaaagggttgcccctggctccggaatttcgccctacagacactgaatttgccgacccaattgcttatatttcgaagattgagaaggaagctgccaactttgggatttgtaagattatcccaccgtttcccaaaccttcaaaaaaatacgttttttccaatttgaataggtcactcttgaagtgccctgattttggtccagataatagttcattaggtgtttgtaattcatcgaaaaccagttctggggatggtagtagtgacggggtgttgcgagccgtgtttactacaaggcatcaagaactggggcagagtcagagtgtgaaaaaagccaaagggacagttcagaatccactgtcaggtgttcataagcaagtatggcaaagtggggaggcttatactctggagcagtttgagtctaaatcgaagtcttttgcgaaaagtgtgctaggatcggtgaaggatgtttctcctctggttatagagtctatgttttggaaggcaactttagagaagcctatatatgtagagtatgcaaatgacgttcctgggtctgcttttgaagagtccaagggtcaatttcattatagtcatagaaggcaaaggaaaaggacttattataagagtaggctagatagctctgattgtaaacaaactgaaacgggttgcgtaagagatacccaaaccgatgagaccaaggttgcttctgtccaaagtcattcggacacatgtttgcagatggccaaatcaagtacaactgtgtcaacattttcatcaaatgatgattcacaatcttctaaggaaaagagttcagatgccagcaatgaaatgcaaggcactgctggttggaagctttcaaacagtccttggaacttgcaagttattgcacgctcgtctggctcactaacacgttttatgcctgatgatattcctggtgtcacgtcacctatggtatacattggtatgctgttcagttggtttgcttggcatgtagaggatcatgagcttcacagcatgaattttcttcacactggctcatcaaagacctggtatgctgttcctggagattatgcctttgcttttgaggaagtcatccgcactgagggttatagtggtaacattgatcacttagctgctttgaaacttttgggtgagaaaacgactcttttatcacctgaggtaattgttgcatctgggattccttgttgcaggttaactcagcaccctggtgaatttgttgtgacttttccaagagcttatcatgtaggattcagccatggttttaactgtggggaagctgctaactttggaactccacaatggcttagagtagctaaggaagctgcagtacgcagagctgcaatgaactatcttcccatgctttcccatcagcaactgctttacttactgaccatgtcttttatttcaagagtgccaagaacactattacctggcgtgcgtagttctcgtctaagagaccgtcagaaagaagagagggagtttttagtaaaacaggcttttatagaagacatgctgcaggaaaacaagcttctatccattcttcttgggaaggaagcaactaaaaaagctgttttatggaatgctgatttactgcctgattccagcaaagattttcagttgcctgatttaacttctactactggatcctctatggcacatatgtcaaatattagttctgcagaaaagagtggtcattatctgcttgatgaaatgagtttgtatatggagaatttgactaatttagatcttggtggtgatgatcttccatgtcacttccaaactgattcaggagcattggcttgtgtgggttgtggaatccttggttttccatttatgactgtgatacaaccaaccgagaaattgataatggaacttcttcctgataatcatctagttcaagtttcctctccagactctactgcttgcgttcatagttccatctcaagggatctttctgtttccgaactttcatcagtaaaggagttgccagatcaatcattaaacaagtgcaataaatgttggaacacctccagtaagtttttgaggcctcggattttctgcctggagcatgctgttcaaatatttgagatgttgcagagcaaaggtggagccaatgtgcttataatttgccattcagactaccagaaaataaaggcacatgccagggcagttgcggaagagatacatagtgcttttgattataatgaggttccattagatactgcatccccagaaaatttgactttgatagatctggcaattgatggtgaagaacatgatgaatgtgaagactggacatctaaactaggcattaacctacggaattgtgtccatgcaagaaataactctccatctaaacaagttccttggatactagggacgctgttgtatgataaatgccttgcttcaaaatctttagctttaaattggcaatcacggagatctcgatcaaaaaggtcaagttgtttggctcagactaaaccgtgtgacagtattgagagaaagaaggaggatcggttttatggaagaatagatgactcccctgctgaaaagaagctacttcaatattcaagaaggaagttcaagtcaaagcaaaggtgtttccctgtagcaagcatggtcagtgaattccaagagaagtccaaaaatttgtcagctactttgaatggggatcataataattgtttttctaaaactgatcttgaagctaagaatttcaggagtgattatgcattgtcatgtgtctctgcttctaccaaaatgtctccaatacatcctgaaatccagattgctgaaatgcctgctagcacgagattaaacgatgctaaaccgcaaccttccaattccattcctgatcatactttaatgactgaagaagttggagcagagattgagaagcaaaccatacaggaatcagatgtagacagaaataatgatttaacactcggtcattctaagatgcattgcaataccagtgtctcagaaatatgtggcaaggagagccaaggttgtcaggacaagaaatgttctagctcacttacaaatgcaactgatagaaatattgaaatgattagaatttctgaaattacagaagcaattatcatcgatagcaggtgtaatagcttaattttgaatggtgaagggcatcaagaatatcagtctacctgcaaaagcaacaatgaggaagctgctttatcacctgcttcattggtaaatcaatctaccctggcatctgtggttggaagttttggaagtccaaataataattatactgcagaaaaaattagcagtcctattttcctagaaaagacaactgaggaagaaattgattctttaagcgaaagggacaaggaacctctaattgatgacagaccaattagcgaacatactctaaaagaagtttgtgaagttcaaagagagctttatgcttctgcagacttgcataataccatagtcttggattatgagatgcaacatgaaactcagggtggaaaagatagcagaaaagaaataaatcagtcaactcttgtttcaacaattacaagaggggaatatgctgaagggttgaatgatgaagtgattccaaagtctgtggagcagtgccagattgaaaatatgaataaaattaatgtggaacctgtttctagctatgttgcaaaaggtgaaaataaatgtgtaacttcatcagaattaggatgttctgaagttttagtggaaacctatcctaaagactcctgtattcaattgatttcagataaagaaaaagaaacggaaatccagtcagtgagtataattgatgaggaattttgctctggcacagatacatcgatagatgactcttcatcaatccaggaatgttctaaaattgagaaagagagctgtgttacagaaaacataaatggaatcaaagccaatttgtcaaaagataatagggagctggaaagctgcgagttgactacagcagttcccagatcaaatgccaggaagaataaaaagagaaaagtgaaaaatacaacgaagaatcaatccaatattgacaactttattagaagtccgtgtgaggggttgaggccaagagctgggaagattgccactgacaaaagtggggtggaaatcaaccaagttgacaaggaaaatcaggtggctaaaagggcaaggagatcttctgaaggtttggttcctcacaaaaataaaaaggatgatgttaaaaagccccataagtgtgaccttgatggttgccaaatgagtttcaagactaaggctgagttactactgcataaacgaaacctttgcccacatgaagggtgtggtaagaagttcagctcccacaaatatgctttacttcaccagcgtgttcatgatgatgagaggccccttaagtgcccatggaaaggttgttccatgtcattcaagtgggcttgggcaaggacagagcatattcgcgtacatactggggagaagccttatcactgcaaggtcgagggatgtggcctttctttcaggtttgtatcagattttagcaggcacagacggaaaacggggcaccatgtgaaacctcctgcttgagaagatataatattcatttgttaactttttgttctcgcaacatgtgcatatttgcagttagattggtaaaagtgaggcatagagtcatgtctgaccataagcattctggttagttgtaaagttaggatagaatggttgttttgtaggtgcacaatatccaattcattcgaaggcagttagagttggtaacttcagagagttttgatctttctctcttactagaattcagatctagcaacatcctctaaaggagggaaaactctccctaggaagctgcatcatgttggttggtcatgcctatgatagcttttgttgattgcctgtacttatggttcttttgaagcagttgataggaccttgatctttcaggatatataattgttcattagggctgtatattactttggattaacattatttattattaagggggacaagaaagttgagagtaaaaacaaggtatgtgctctcaatgattgtatgtactctaccctcttcgctagtaaattcagtggttaaacattcggttgacactgcatattctaatttggttgtctaccctttta

SEQ ID NO: 205 - DNA, 1171 bp, Glycine max
  misc_feature (1)..(1171): Glyma.10g243300.1
agcatcttctttcaactgctgactaacgttcattccgctcttcgctttctttcacatccaatcaacgaaaaatgctggctgttttcgacaaatcggtggcaaagagcccagagggtcttcagagccctcactcaaattccgtctcagccctaaaagacggttttctcgcagagcacttctcttccgttcaccctggttccgtcaccgttaaccttggctcttccggtctcttggcctattctcttcacaaacagaaccccctcctcccaaggctgtttgcagtcgtggatgacattttctgtttgtttcaaggtcatcttgagaatgttgctaaccttaagcaacaatatggattgaacaaaacagcaactgaggtgatcattatcattgaagcatacaggactctaagagatcgtggtccctatcctgctgctcaggttgtgagagacttccaaggcaaatttgcatttattctgtatgacagtggttctaagactgcatttgttgctgcggatgctgatgggagtgttccctttgtctggggaactgatgctgatggaaatctcgttttctcagatgagacagagatcgtaactaagagctgtgggaaatcttacgcaccattccccaaaggatttttcttttcaacatccggaggtttgagcagttttgagcatccactgaatgaggtgaagcctgtaccaagggttgacagttccggacaggtgtgtggtgcaactttcaaggtggatgctgaggctaagaaggaagcaactggcatgccaagggttgggagtgctgctaactggtcaaataatatctgattgcgactctattctgtttgaattatgggcttttattttatcatagctgcactcggctgcaagttctggacctgttcctatattatgataactttgaggctttgcttatcatattaatttatttactgaatctgacatgatttcatgaagttatacaaagttgctttgaagcaaatggttaagctcatactctcttcgcacttatcttgtaataatataaacttgcggacaggttcatccaaatgattatttaccgcctttgttttatctcgttttatttagccttatctgtgccttacctaaactatcaaggtgatgaatataatgtcaaaaatagactctctcta

SEQ ID NO: 206 - DNA, 2949 bp, Glycine max
  misc_feature (1)..(2949): Glyma.09g023300.1
gagagtattttagcctaggaatatatggagaaagggaagagcattgcagcagggtttttggtgggtttccctgatagacccaaaacaaggacgaaatgcgtcgacgcctccctctcttggcccactccctcctcttcaaacccaccatcaacaacaatcccctacgcttcctccccatcctaaaccatcctccctccgcccctcgccgcttctcctccgccaccccctccaaagacgacggcgtctccctctgctgccagatgtggatcgacaacttccgccaccccgaccgcgccgtcacaaacctctcctccttcctccgtcgcttcgacctctgggtcctcgcctaccagaaggtcgccaccgacgacaccggctcctacacctcccgctcctccctccacgcctccaccctccaagacctcctcgccctccgcaacgccgtcctcgacgcgaaattcaagtggggctccaggctcaagttcttcatcaaatcccccaaagacaaaaccgactacgactccctctccaagcgcaaaatcaaaaccatcctcaccaccacacaacccgcgccgttccaggacagaatcgttcatgaagttctccttatgatcctcgaaccgatctacgagccgaggttttcgccaaagtcgtatgcttttcgacccgggagaacaccccacactgttttgagggttattaggagaagctttgctgggtacttgtggtatataaagggtgattttagtgttttgttggatgggatgaaggtggggttggtgattaattctgttatgagagatgttagggataagttggttgttgatttgattaaggacgcattggttacgccggttgttgttactactgtggagaagaaggagaagaagaagaagaggaagtatcagaagaagagggttttggccgaggatgagcctaagcccgatccttattggctggatacgttttttgggtttgcacccgaggaggcggagagggtacccaattgggggcattgtggggtgcttagtccgcttttggccaatgtttgcttggatgagttggatacgtggatggaggggaagattaaggagttttatgttccttccaagagtgatgttatatggaatagtcccgaggaggagcaggggaacacgtcgtggccggagttcgtgcccacgagtgggccggataagacgaggaagatggattttgtgaggtatggagggcatgtcttgattggtgttcgagggcctagggcagatgcggctgcgttgaggaagcagttgattgagttttgtgatcagaggtttatgctcaagcttgataatgagagcctccctatagagcatataaccaaagggatcatgtttttggaccatgtgttgtgtaggagggttgtgtatccaactcttaggtacactgccactggtggtaagatcataagtgagaagggcgtggggacgctgttgtcggtcacggcgagcttgaaacaatgtattaagcagtttaggaagttgagttttctcaagggggatagggatccggatccccagccttgttttaggatgtttcatgccacgcaggcacacaccaatgctcaaatgaacaagtttttgtcaaccatggttgagtggtatagatatgcagacaataggaagaagattgtgaacttctgttcttatatcataagaggctcccttgctaagctgtatgctgcaaaatacaagcttcggtcgcgtgcaaaagtgtacaagattggtgctcgtaacctgagccgtccattgaaggagaaaaaagggcagtctcctgagtaccataatttgctgaggatgggtcttgccgagtcaatagacgggctacaatatacgaggatgtctcttgtgcctgagaccgattactccctgttccctagtaattggaggcctgaccatgaaaagttgttactagaatacataaaactggaagatccaaaaactttggaggaacaacgggattgcatcagagaacaaggtcttgtttcacctcaagactatatttcaatgctcgtgtggaattataaaaggaactctcttcctatggaccagctctccttagtaaggagcaatgaaagtgttgtaggaaatcagcatttgctagttggctcaaaccaggatgaccaggaccacacaaaccaagaagaagaaaatgatggaaggatgaatgcagcacaaatgtaacacaaagattcagacgatgccacaactttcgtgagcaattagcttggtacaatgataatcagttcatctttggttcagtttggcaacctcttagagagattttgaaaaataagttgatattatgtttcacctttccaccatggatgcttgccagagaaaggatacaataactgaagaatggagagctctgacgtgctggcatccactcaggcaaaatattaacactgccactctgctagtgggaacactgactgggctataaggtggcaaaaatccacgcacttgaaaatgtggaaagtaattccacatacttttctggagtgctatatctgtgagtccacaggaaggagtatgcagctttctgtaataaagtgtgttcctcgtggatgcatagcagcataggacaaggcaaggtgtgaattgaagtactgaactccaacaagatcatttcatatatcatgttaattttgtaaattggctatttgtgatttgtccatacgtgcttgctccaattcatttttctaatgatttgagcatacccgcaactcttagttcttgaatagcacatttatatgtatttttttttcactttattttctgtacgggcaactcaatgctgtaagaacttcaaagcagtgtactaggaagaagctcgttatactacattatgagtttctcctttgattcctcattttaaaataataataattattataatttattttgtaaa

SEQ ID NO: 207 - DNA, 2320 bp, Glycine max
  misc_feature (1)..(2320): Glyma.17g213600.1
acctggttttgctgttcccctcatttctttaattactacttccccgttcgagttcacccactcacccaaacacgccactttccagttatcatcatcatgctttcgttttccactctcagaagatcctcacccttcctcgcccgacgcttctcaacccaacggtcccagatccgccacgcgtcaacctcctcctcctcctcctcctcactccacaacaccgcgaacccggttcgaacctggttcggtcgaaacgcactctcgaccgtcctcgccggcgcgagcgtatcagggcttcttctctacggctactcttcttcgcacaattccgagttcgactcgtctctgctgaagagctcaatttcttctctcgttgaccggtcaacgccgatttccgaggaccaagaacggcgtcgttcgttcctttcgaaaatttcgctccctgaatgttccggtgccttgctatttggagattcgttcaggagaaaggttttcttcaactatgagaagcgcatacggttgcgaagccctccggaaaaggtttttgagtactttgcatctgatcgtagttcagaaggagaagttttgatgaaaccagcagacctaatgcgagcagtggttcctgttttccctccttctgaatcccaccttgttagagatggatacttggaaggtgaaaggaggccgggccatttatgctgcccttcttcagaattttttatgctttttgatgtaaacaatgatgggctgatatcttttaaagagtatatcttttttgtaacactactcagcatcccagaatcaagcttttcagtgacatttaaaatgtttgatgtcaacaataatggggagataaataaggaagaattcaagaaagtgatggcattgatgcgatctcgtcatcgacagggtgttcaccacagggatggactgcgaactggcctaaaggcgagtgattctgtggaagatggagggctggtggaatacttttttgataaagatggaaatggatgcctccaacatgataaatttgtaaattttttgagaggcttgcatgatgagattctgaggctggagtttgctcattatgactaccaatcttgccaaaccatatcagccaaggactttgcgctctccatggttgcttctgccgacatgagtcatctaggcaggttgcttgaaagggttgatggactgaatgatgatccacgccttaaggatgcacgaatcacatttgaggacttcaaaaactttgcagagctacggaaaaagttactgccattttcattggcccttttcagttttggagaagtaaatggcctgttgacaagagatgattttcagagagcagcatcacatgtatgtggcatatctctctcggacactgtggttgaaattgttttccatttgtttgatgcaaatcgggatggaaacctaagttttgacgagtttgtcagagtgctacacaagcgcgaaagggacattgcacaacccgtggagacaggaatacggggttggttgtcttgcggttggaactgtacgcataacttctcatcttcatgattgttttcctgatatagaagatttaatgccacaaacatttcaagaacagacataacagaatggattggaacccttgatgggaagagaaaaacgaaagaaaaacaaaggaagagatgggtagtgatggttggtctgggactggagaagtttcccgtaaaatacatttgtgggtcaaacacaggtcttccttatatcacctcactttgcagtacccttaaagaaaagatgggcacataaataatctacttcgtaatagcttagaaatcaaacaagtatgtgtgtttgggaacccgtttgcatacttgcaatgcaaacggaaatacccactttcccatgcacaaaaatgagaagtaacaatcgccgacgtctgaggtttgccaactgcaaaccaaacacactcatatattgtaaagtcaatatgtaccactgaggtggtcacctgtttttccccctttgtgcttttgattttgggttgaatggtgatacccaacacctggaactattttgccatgaatggtgatactatttatgaatgctttgcggtttatgttgatgtaatgtagtacataggtatgggcatgcagctataacaaatactctagctctttattagtgcacaattcagagagagtacactgtacagtgagattgttagccttgaggagaaaagcgggggagtaaattacaaggcatcatcgaatatattacaaaatctttgtattcctttcgatccatatctgttgattatgatttttgaacc

SEQ ID NO: 208 - DNA, 2182 bp, Glycine max
  misc_feature (1)..(2182): Glyma.03g013000.1
aaaaaaaagaagagggaactagtttctgcattctctgtttctggtgttgttcacttgttctcttcatttcaagtttcaaccttaatccttccgaaccaacacataaaaatccaacactctcttcttcttcttctctctccgcgggttcaattgaacctcacaaaaccctctttctctctctctagatctgttcaaatcccgaatcatttccgctccaatttcaatttccccgaacaagagcaaaccctaaccctttctctctgtatgatacctgattttttccctcaggcgtgtagttttcgtgccgatttgtaaattctttcggtagtttaggttagaatttttttttgttaagtttttagggttttgaatcggtgagatgaatcacaacaacaacaatagagcgaggtaccctcccgggatggggcttgggcgcggtggtttcaatccgaacccgagccagaacccgaacttgaaccagaacccgagcctgaaccagaatcatcacgcgttccaggctcggccaccgtaccatcaccagcaacaacgggtgcagtacgtgcagaggcatttgctgcagcaacagcagcagcaatggctgagaagggacggcagcgccgccgtcgacgaggtcgagaagaccgtgcagtctgaagccgtggattcgagttctcaagattggaaggcaagactaaagattccaccagctgatactcgctataaaacagaggatgtaacggcaactaaaggaaatgagtttgaggattactttttgaagcgtgagctgctcatgggaatatatgagaagggttttgaaaggccttctcccatccaagaagaaagcattccgattgctcttactggtagtgacattcttgctagggctaagaacggaactggcaaaacagctgcattttgcattcctgcattggaaaaaattgaccaggataataatgttattcaagttgttatactggtcccaacccgagaattggcattgcaaacttctcaagtgtgcaaagagcttgcaaagcacttgaagattcaagttatggttacaacaggtggtaccagcctgaaagatgatataatgcgcttatatcaaccagttcatttactagttggaactccaggaagaatattagatcttgccaagaaaggtgtttgtattctgaaagattgtgctatgcttgttatggatgaggccgataagcttctgtccccagagtttcaaccttctatagagcagctgattcattgtcttcctacaacccgtcaaatcttgatgttttcagcaacatttcctgttactgtaaaggatttcaaagataggtatcttcgaaaaccttatgtcatcaaccttatggatgagctaactctgaagggtattactcaattttatgcattcgtggaagagagacagaaagtccactgcctaaatactctattttctaagctgcaaataaaccagtctatcatcttctgcaattcagtgaatcgggttgaacttcttgccaagaaaatcacggaacttggttattcatgtttctacattcatgcaaagatgttgcaggaccatcgtaacagagtgtttcatgacttccgcaatggtgcatgtcgaaatcttgtttgtactgatctttttactagaggaatagatattcaagcagttaacgttgttattaattttgattttcccaagaacgcagagacttatttgcacagggttggtcgttcagggaggtttgggcacctgggtttagcagtgaacttgattacctatgaggatcgctttaatttatataggattgaacaagaacttggaactgaaataaagcagattcccccacaaattgatcaggcaatttattgccggtgattggctgtaaataccatggttgtgtttaccattgtggctaatagcagtggttagtgtgaccgtggctaaagtaggtgcaagagaggatttgcaaagcaagtgacaaattctgtattagtggaccctggtatgggaggatgcactgtcgagaactgggtattattggacccattaattgagtgctttcggattaattccagtttgggtttctgttgattacatttgcagaacggtcgatcattttaaataaattaaaataatttatagtatgtttggatgagtgttaataaaattgatttggtt

SEQ ID NO: 209 - DNA, 1604 bp, Glycine max
  misc_feature (1)..(1604): Glyma.19g003900.1
cactcactcacaataaataaaataaaaagggttttacaaaatataaacaatatctagggtttctctttctcttttgcattctctctgaattcgtatgccatggagtcacccggtaacgagcatgtggtgggtggcgcagaacccaacgacgtcgttacgcccttttcccacagagaagaacctcacaattcccaacccctcaccggcgacggtgccagtcccggaaagatatttataggtggtttagcgagagaaacgaccattgcccaatttatcaagcactttggtaagtatggtgagatcacggattcagttatcatgaaggacaggaaaactgggcagcctcgtggattcgggtttataacatatgcggatccctctgtggtcgataaagtcattgaggaacctcatgtcatcaatggcaaacaagttgagattaagcggacgataccgaggggagctgttggctctaaggattttaggacaaagaaaatttttgtaggtggaattccttcaaatgtgactgaagatgaatttagagacttctttacacgctacggcgaagttaaagatcaccaaataatgcgggaccactccaccaaccgatctcgtggctttgggtttatcacatttgaatctgaagaagcagttgatgatcttctgtccatggggaacaaaattgactttgctggagctcaggtggaaatcaagaaggctgaaccaaagaagccaaactcagcacctccatcatccaagcgctataacgactctaggtcttcatacagcagtggtggatatggagatgcttatgatggatttggtggcagctttggaatggggggtggttataggtcaggtggtgcttatggtggtggtaggggtagtggtgcttatggtggctatgcaagtgaatttggtgggtatggaggatatgctggtgcgatggggccgtatagaggagatccctcccttgggtatgctggtcgttatggaggaagctttagcagagggtatgatcttggtgggtatggcggacctagtgagaattatggagcatatggggcaggtgggggttcttcgggtggtgctggtgctggtgccggtgccggtgcctaccaaagtggctatgatggaaacctgggagggggatatggaggggctagtggaggccccttctatgggagcactagaggaggatacagcgctggtcgatatcatccttatggaagataagattggaaaccaagcatttatagtctaggactaatatgtctagcatcaaagcaggtttgtagtttgtgttttgttcatcagatagattatatactctttcaaaaaaaaaaaattgtcaacgttactttcatttatgagcatacccatttcttgaaagtccaaacaaattttctatttggctccccctttgagtctggtttatgtatgtaagagctgcaaattgtgtagacgggtgtattctcaatcttgttcattgttgcttgtaatgcttctaattaccatcttttgttttttatttgatttaattactccatgctggtttgttattctatacatgagataaactttctaacacttttattggttgaata

SEQ ID NO: 210 - DNA, 2640 bp, Glycine max
  misc_feature (1)..(2640): Glyma.03g008100.1
caaattaaaacactacttttgcttcagtagtgtttggtgtgtgtgtgtttttttttctctggctcgatctctccccttttcctctccatgttcctcaactaccctcatttatttcccttcattgattgcttgcctcacttgaacaccctgttgcaatccctctaagagagagagagagtgagaacatggagaagaagctctagttagtgttgtgggtgtgtggtttcttcttcaagagtgagaaagagagagagaggtacaggtgggtgtcttcatctttaaaggcctcaactaacccttcagagagcatttatattggcgcatctgaatgagtttagtaagagagagaaaaaaagggtgcatggtgatgcattgtcaagaaaccagtctggccacaataactcttcactaaaccacttcacctataaatctctcttcaccattacactcttaccctcattatactactactactacactcactcattcattcactcacctttccataaacacaaccttcttcactttgctttactccttcattcattttcctctcatactcaaaactctgcatcaaaatgctcatcattgttcacaccacccattcttgaaagtttcgagtctttgattattggggtggttaatattgcacttgcactatggaaacttgcacggctctattgtttttaacggcgatcacagcatacttgatatggttcacgttcatctcacggtcgctgaagggtccacgtgtctgggccttattgggcagtctcccaggcctcatagacaactgtgaccgcatgcatgactggatctgcgacaacctacgcgcgtgtggcggcacgtaccagacctgcatctgtgcaatccccttcctcgccaagaagcagggtctcgtgactgtcacgtgcgacccgaggaacttggagcacatactcaagacacgcttcgacaattaccctaaaggacccacgtggcatgctgtctttcatgatctgttgggtgatgggatctttaacaccgatggtgacacatggctgttccagcgcaagacagctgcgctggaatttaccacccggacgctgcgccaagccatggccaggtgggtgagtcgagccatcaaccggctctgtctgattctcgaaaaagccgagaatcaagtcgagccggttgatctgcaagacttaatgcttcggctcacttttgataatatttgtgggttggctttcgggcgagacccacagacttgtgtgtcaagtctgcccgataaccgatttgccacggctttcgatcgagccactgaagccacgctccaacgattcattttacctgaggtattgtggaaggtgaaaaaatggcttcggcttgggatggaagtcagcttgagccgaagccttgcccacgtggacgaccatttgtcaaatgtgattgagaaacgcaaggtagagttgttgactcagcagaaagatgggactcttcatgatgacttgttgacaaggtttatgaggaaaaaagaatcctattcagacaagtttctccaacaagtggcgttgaattttatcctagctggtcgtgacacctcatcggtggcattaagttggtttttttggttggtgattcagaaccctaaggtggaagagaaaattctacgtgaaatttgtacagtcctgatggagacacgtggcaatgatgacatggcaaagttgtttgatgagcctttggcctttgaggaagttgaccgtttggtttatctcaaggctgcattgtcggagacactaaggttgtacccttcagtgccggaggactcaaagcatgtggtggccgacgacgtgctgccggacgggacattcgtgccggcgggttcgtcggtcacatattcgatatattcggcggggaggttgaagtccacatggggtgaggattgcatggagtttaggcctgagaggtggttgtcattggatggaacaaagttcatcatgcatgactctttcaagtttgtggcattcaatgctggcccaaggatatgtttggggaaggatttggcttacttgcagatgaagtccattgctgcggcggtgctgctccggcaccgccttgtgctggtgcctggacaccaggtggagcaaaagatgtcactcactcttttcatgaaaaatgggctcaaggtcaatgtgcatgagagggacttgagagggattatcacaagtttaaaaaaagaaagggagggagatgttgttgatttgagaagtgatgaataatgttagtgaccaggtgttcactagatggagacaggttcaaatgaggagaattcagacactggctggggctttagcttatagaacaagagaacagaagttcctcttaagaaaaagggtatattcagagtatttataattcttatgataaattgtggatggattctttttccagggtcgtgggatggatgattgctttctcaatccatctttccttgtagaatccttgcaaatattcattgtattctttatttcttgttggttttcatgtttctatttaattttactggtggtgagaactaaactcacatttcacaatgttgaatgttgatgttcataaaagaatgccttacgttttatgaaagtataatgatcggatttt

SEQ ID NO: 211 - DNA, 1673 bp, Glycine max
  misc_feature (1)..(1673): Glyma.16g115700.1
cagacaaagtatagcgttcgccatttacgtttccatgtgccataatgactgtctgttttccgaacaaataaaataaaaaaaatattaagacacgagacaagatggaaactccgagaagagacgaaaatccacatgacatttttgcccctcacactttcccctgtttactccacgccgcttccttgttccttcataaacacaacacttccttcttacattcggcaatcaaaccatgcagcgcacggcggcggcgacagaggaaccacggcggagctccggcgacgcgtcggcggcggagggggagaaggtgttcaagggaagtgaggtgttcggtgatacgtcaccaaattatttaaagacgattttggccctggcgctgtggctcggaaccattcatttcaacgccgcgttggtgctcttcgcaatcttcttcctctctctccacaaagcattcttacttttcggtttgcttttcgtgctgatggtgattcctgttgatgaaaagagcaaattcggtagaaaattatccagaagaaaaaaaaaaatttgggtgtgtttcaggtacatatgcaagcacgtttgcgcttactttcccatcacgcttcatgtggaggatatgaaggcttttcatcccagtcgtgcttatgtttttggttatgaaccacattcagttttgccaattggagttgttgcattagctgacaacacatgttttatgcctcttcctaaaataaaagttcttgctagcagtgcgatattttacacaccatttttgagacacatatggacatggttgggtctaacgccagtgacaaagaaaaggtttacctcgctgttggatgctggctatagttgtatcttgatacctggtggagtgcaagaagcatttctcattgagcatggttctgagattgcctttcttaaatcaaggagaggatttgtccgcatagcaatggagaagggaaaacccctggttccagttttctgctttggtcagtcaaatgtctataagtggtggaaaccaggtgggaagttagttctgaattttgcgagggctgtcaagttctccccagtatatttttggggaatttttggatctccgataccctttaaacatccaatgcatgtggtagtgggtagaccaattgagctcgagaaaactcccgagccaactcctgaggaggttgccaaaatacatagccagtttgttgaagcacttcaagatctatttgaacgacacaaagctcgagctggatatccaaaccttgagttgagaattgtttgatatggtcataacttcgacccatattttcatggggttaattacacttatctcctctcaggtcaggctttatttgggagttttgaagatggagtggagtgattagttcatgataattggatttggaatggggagaggtaaaacaatgctgttgattgattgagaagggagtcatctctgttgttttagaagtcacgggtaattaatcatgtaaactgtgttagtttaacttcctattgagtctgcacgatttatatcagaaatagttataaatcttagattaatttaaaatgttactttatgacatagggtgtgtttgggacaactgtaaaagatagattatttcaataatcgattataatcatcatcaatttttgtttgtatgcaacaa

SEQ ID NO: 212 - DNA, 2165 bp, Glycine max
  misc_feature (1)..(2165): Glyma.15g255900.1
tcaaaccataaattccaagtagacgcagcgaatcacgttttgttcgagcttcctccattctcaattttcagaatcgatttcgaagagctgcttcgtctttgctccaccaaaattcttcaccgttgtagttgtactcagccactcggagacaccgctaatcgatagtttagttggcaagtcataaattagtttcatctcttaagatttcattggaagcagtcaaaatgtcacggaagggtttgatggaacaagacctgagtaagttggatgtgacaaagttgcatccactttctccagaagtcatatctcggcaggctactattaatattggcactataggtcatgtggcacatggcaagtcgacagttgtgaaagcaatatcaggagtccagactgtgcgtttcaaaaatgagttggagcgtaacattacaatcaagcttggctatgctaatgcaaaaatatacaagtgtgaagatgaacggtgtccaaggcctatgtgctacaaggcttatggaagtggaaaggaagatagtcctatgtgtgatgtgccaggatttgaaaacagcaagatgaaattgctgagacatgtttcatttgtggattgtccgggacatgatattcttatggctacaatgcttaatggagcagcaatcatggatggagctttgctactcattgctgccaatgaaagctgcccacaaccacaaacctctgagcatttagctgctgtggaaattatgcgtctacagcacataataattcttcagaacaaggtagacttgattcaagaaaatgtggctatcaatcagcatgaggcaatttcaaagtttatacaaggaactgttgctgatggtgcaccagtagtacctatttcagcacagttgaagtataatattgatgttgtgtgtgagtatattgtgaagaagatcccaatccctgaaaggaactttgtttctcctcctaatatgatcgttattcggtcatttgatgtcaataaacctggttatgaggttgatgaaataaaaggaggtgtagctggtgggagcattttgaggggtgttttgaaggtcaatcaattcattgaagttcgtcctgggattgttgttaaagatgagagtggaaatatcagatgcacgcccatatactcaagaatagtttcattgtatgctgaacaaaatgagcttcaatttgctgttcctggaggcctaattggtgttgggacaacaatggatcccactttgacacgtgctgataggttggtaggtcaagttttgggagaggttggatcactacctgaggtttttgttgaacttgaggtaaactttttcctgcttcggcggctccttggtgtccgaacaaaagggtctgagagacagggaaaggtatccaagctggctaaaggagagatgttaatgttgaacattggatcaatgtcgacgggggctagagtagttgctgtgaagaatgacttggcgaagttgcaactcacttcccctgtgtgcactagcaagggcgagaagattgcacttagtcgtcgtgttgagaagcattggcgtcttattgggtggggacaaatccaagctggaatcactcttgatgtccctcccgccccccaactgagttgaacactgataagagacagatcacaagaaacaccagcagctataaaaacctgagacgaatttagatgtgggaagggagacaagtgttgggaaccatttttgtgaggtggagaagaaaacgttttgattgtcgtctatttttgttttcacatcgttattggtttattttccccactgtacctattattgaagctgtatcctatactctgattgagttcaggctgggagcgagaatctcagccagtacttgtttcattccatggcatctttaccgatattcaaaaattggttcgccatttgataccgtgaagcatttcattatgaaactacataatatccaagcaatggttgaaaatactagactctggtaagcacatttcctgtaattgattgtacttattatgtggggtatggagttctgaaggtaatttctgggcaccttaattagaaggcaaaattgtaaaattggttcctcactttatcttcaattacgtatttggtcctcttataatttaatttacaaatttggttcctcagttttat

SEQ ID NO: 213 - DNA, 1317 bp, Glycine max
  misc_feature (1)..(1317): Glyma.05g004900.1
gaaaaacttgctctattctgtatattatctctgaacgttctgtttccttcaattcgtggcctctctcagtagaatcaccactttctgccaccgtcaggtttctgacttggttttagtaaggattcaccttttcttatatcagttggtggaaactataaattgtggctggagttggataggaacggagcagaacagaactatagtatctcatctctcttgatagtagaagtggtgctgactttcttgtgatcagtgatgctggtgaaatctctctcacttcattctcatgccttctcaagttgcagtttttctgcaagtgaaattggaacaaacccaagttgggttcccttaaagtccttaaatagcctctgctgttcctccaagcctagaaatttatgcagatttttgtgtctgagcactcaaaatggtggcttcagagaaaactctggtgaagttggacttggagatgcagtgataattgtggatcatggctcgcgtcgcaaagagtcaaatctcatgcttaatgaatttgtggagatgtttaagcataaaactgggtatgagattgtggaacctgctcatatggaattagcagaaccatcaataagagatgcttttcaatcttgcgttgaacaaggtgctcatcgcattattgttagtcccttttttctctctcctggaaggcattggactcaggatattccttccttaagtgcagaggcagcaaaggaacatccagatgtgtcatacattgtaactgcaccccttggattacatgaactacttgtggatgttgtgaatgatagaatcaaacattgcttaaagcatgtggctggagatgcagatgagtgttcagtttgttctgggactggtaaatgcaggctctattaatttgtgaaactagattgttttggatgctattaaatgaggctggaagtcgaggaatctgtaaattgggttgcaactgttctgaagttgttattacgacgcacttgaactttgcttcatgtttggttcgacgtgacttcttgaggagcttcgtttatgtttcttactccaagttgtatcagtatttaacattaatgttgaggtttcgcttacccatttgcaaatcatcaagaaactacccatctttctctctatttatttgtgatttgtgtcaaaataaataaatgaaatgaaattaagaatctgccttatttgctcgacaccgcaaataaattaaggaccttgttaagtctatatatgttgtttataatatatattctttcaatacaatattttaataataagtattgcaaatattgtttttattat

SEQ ID NO: 214 - DNA, 1374 bp, Glycine max
  misc_feature (1)..(1374): Glyma.15g248800.1
aaaagggtgtaagtagcaagggcaatagttccctatcaagttccgagttccctctccgctatctgtgatcctacactgcaccctctccgctcctgttcgaaccttgccgccgtcatcgacgagaaggaagaaatttgaatttgaagaaagatgggagagaggaaggtgttgaacaagtattacccaccggactttgatccgtcgaagcttcccagagcaagaaggccaaagaaccagcagatcaaggtccgcatgatgcttccaatgagcattcgatgcaacacttgtggtaattacatctacaaaggaaccaagttcaattccagaaaggaagatgttattggcgagacatatctgggaattcaaatattcaggttctactttaaatgcactaagtgctcagctgaggttaccatgaagactgatccgcagaattcggattacatcgttgaatctggtgcaaccagaaattttgaaccttggcgtgcagaagatgaagaagctgataaaacgaaggagaagagggatgctgaagagatgggagatgctatgaaatcattggagaatagaaccctggattctaaaagggagatggacatccttgctgcattggatgagatgaagtcaatgaagtctaggcatgcaactgtcactgttgatgaaatgctggaggctctgcagcgcacagcagctgacaaggagaaaaggctggaacaagaagatgaagctctgataaaatcagttgtctttcataattcagacggttttgtcagaagaattcgtgatgaagatattgaaacagaggagcaattggatcagttttcaaatggacatggcgaaacatccagttctaatactaagaggcaaaagatttcagaagattgtccaagcaaaccaactgacactctgacaaaagccagtttggatgattctggcaaacaagaaaattcacgcagtggtggaaagcttaattctttagtgaggatttctgtcattaagaaaccagtgacctctgacgttaaaagtcctgcagaaccagaacaaaagaaacaagagaaagataatgaaacaaatactgctagtggactattatctttgtgtcaaaattacggaagtgatgatgaggactagtagtcataaatattgaatgactttttgtttaactgttgctcattagattgtaattgtaagttgtacttgcaatggaatgtgtgtcatatgcatatttcttgtatgactagaatagaaatacacagttttcaagctcttacagaaatctgcagaaatgctggttatgttgtttaaggagaatggaagaaaaaaagcataaattagactgatttattttatttgtatatagagcatagatttgtt

SEQ ID NO: 215 - DNA, 2450 bp, Glycine max
  misc_feature (1)..(2450): Glyma.04g007400.1
tttttaattctcttttcccaacagagcaagacctgctgagtctgagagcgactgaatgacgcgagatattttgttgagtttcattaaaccctactatttgtcttcaacaaagaaacacgaacggaacaacatggacgaggaggagccgcgtgacgaaggacaacaaggaggttctgtcgagcaaagcccagagcaactggtggcccgtgccatagcccccgtcaagaaggatttcctccgtcctcctcccgttcgctcttcctctccaaacgacggcgtttccattcccaatgataacaacaagacctctgttctcgccaaggagaagaagtccaagcgccaactcaaacgcgaacgtcgtctggaacaaaagtcagcacgaaacctgtgtcccgaaattgccaaaacaggggatgttagttcatgtccttataaagacaagtgtcgtttcagccatgatttggaagccttcaaggcacagaaacctgctgatctagaggggcaatgtcctttctttaaatctggaggcgcttgcccatatggtttagggtgtagattttcgagtacgcatgaagatggtgtgccttctgccaatctgaatggtcttaagaataattccgaggtgaatgggttgagcaaacatgttcaaaagcttttgtggaaaaataagatgagcttctccaaggcagatgcccaactcaaaagtctaggcctcgtgggaacctctaagtcaaaaaggaatgacttggaaaataaagatgaaggtgacactggttcaaataagtgtgatcattctgattacagtggatcttgtgttgttacctccgactcatgttgtaagttggaatgccctgaagaagttatgaaagatgatgacaatgacatagatggaaaatctgaatctgatgtactttgcccccagaagagaagaaaaattgcagaaaattgtggtcctatggatgcagaaaatgaaggtgttagtgttactgagcaaattgttgaaagaagttgcacaaaatctgaacccgaagctggaaccgatgctctaaccccagaaactgatctaagcctgaagctgcactcacgtgaaaagaagctgattgattttagggagaagttgtatctcgcacccttgaccactgttggcaatctccctttccgaagagtttgcaaagtattaggagctgatgtaacttgtggtgaaatggcaatgtgcacaaatcttttgcagggtcaagcctctgaatgggcattgctaagacgtcattcatctgaagatttatttggtgtacaaatctgtggggcatatcctgatactgtggcacgaacagttgaactaatagagcaagagtgtacaatagattttattgatataaatatgggttgtcctattgacattgttgtgaataagggtgctggatcagctcttctaacaaaaccaatgcggatgaaaagtattgtagaagttgcttcaggcacagcggaaaaaccaataactatcaaggtacggactgcttattttgaagggaagaatcgcattgattctctgatagcagacattggctcttggggtgccagtgctgtgacaatacatggtaggtcacgtcaacaacgctatagcaagcttgctgactgggactacgtataccagtgtgccaggaaagcccctactacattgccagtagtggggaatggagatgttttttcatttgtagactggaacaaccacagaactgaatgccctgaacttgctacggacatggttgctcgtggtgcactgattaaaccttggatatttactgagatcaaggaacagagacattgggacatcagttctggcgagcgtctaaatattctcaaagattttgtgaattttggtcttgaacactggggttctgacacaaaaggggttgagacaacaaggcggttcttgttggaatggcttagctacactttcaggtatatacctgttggtcttttggatgtggttccacaacgattaaactggcgtccaccatcttactatgggcgtgatgagcttgagacactaatggcctcagactctgctgccgattggatacgaatatcagagatgctacttggcaaggttccagatggctttacatttgctcctaagcataaatcaaatgcttacgatagagctgaaaatggttgattctggagttaattttcgataccgattctgatgagaaccgttttcttctcaactgctgactaatgaagagacaagctgaagagacatttgtcagcattcttatctatttgttccattgtgagaattgttcatcattgaccttggacttttcagtcctccactaggaaactaaacatttaataaaacatcgacatttgaaatgtaaacattaaaggtttttagagtcatgccaacttgcatgctcgggtcaattaaattttctgcttgcaatagt

SEQ ID NO: 216 - DNA, 832 bp, Glycine max
  misc_feature (1)..(832): Glyma.05g223100.1
acttgtgccttattctacgttggcctttttcttttggtccagggttttgttcttcctgacttgcatacttgatggcttcaaagttgcagaagttgcaggccacagcatctcaagcgtctcaatttgtatgcagtcgtggaactaactactacaagcaattgctggaacagaacaagcaacacattcaggagcctcctacagtagagaaatgcaacctgttggcaaagcaattgttttacactcgccttgctagtattccgagtcgtaatgagtccttttggaaggaacttgattatgccaagaatttgtggaagaacaggaaagagctaaaggttgaagatgcaggaattgctgctttgtttggcctcgaatgctttgcatggttttgcgctggtgagattgttggcagaggatttactttcaccggttactatgtctgataataaccacttggaaagtgtagattttatcagggctaaacactcctaaagccaactgctctggtcatttatacattgtgtggattatggcattctgcatggcaatttttgttatgataagcctcaataaccccttgtagttgaaagcgggatgaaccttgtgatgttctcttattatgttggaaagctagtgatggtactccacggtgatgatgcctcctgcaattcttttagagtgtgtttggatggaggaattataaattttaagaatttcaaatactttaattgaaattcttttattttcaaaattgtgtttggataaaaaaagttaaaattatgagggtaaaaaaaatgaatgaaaaaaaagaaaggatatgattggtgcgttagtt

SEQ ID NO: 217 - DNA, 2044 bp, Glycine max
  misc_feature (1)..(2044): Glyma.14g204100.1
tgaaggtgaccaaggattggatttatcactaacctaaagacaggagattgtgagacacttcatgtcttcccaaagtttttgaggttttaattacaatatttattaaaaatggattaacatatcatatataacattatatatttcttatattctcattatatatatttgtattatcggagtagtaagaagtagagaaagaagaagacattctcagttgtgttgtctgacaaaacgaacagcaattgggagcagatgcaagatccatcttcaaaccctaattccaatccaaatcccaatcctcacaatgccaatgccgcatcccagctaccgcgtccaccgccggccaccaccgccggcgccggcgcctcctcgtcctcgctgttcgcgcgctccggcgggcctcaccaccggcgagcccattcggaagtgagtttccggctgccggacgacatgatggacctctcgccgtcggatccgttcgccggcgggtcgtcgacggccagcatggaggagatcggatcggaggacgacctgttctcgacgtacattgacgtggacaagctcggcggcgcaaacgggtcgggcgcctccggaaacggagcggatccgaccggcgaaaccgagaagagtccggcgaggccgcgacaccggcacagtagctccgtcgatttcggggaaattatggatgcgaagaaagctatgcctcctgataagttagctgagctatggacaattgatcccaagcgtgctaagagaatacttgcaaatcggcaatctgctgctcgatcgaaggagagaaaagcgcgctacatacaagaacttgagcgcaaggttcagactcttcagacggaagccacaactctttctgcccaattgaccttataccagagggacacaacaggactgagtactgaaaatacagagctaaagctccgtttgcaagccatggagcaacaagcacaacttcgtgacgctcttaatgaagcattgaagaaggaagttgagaggcttaaggttgctactggtgagatgatgagccacactgattcctttaatctgggaatgcacctgatgccattttccggatcaaatttcgttccaatcccgccacaatcaggtccttctggtcaccaaaacatgcagatgccaccatttggtctcaccccatccacaatgccaagccatctactgcatcaaacaagttctcatccatattcagaaatattgcaaaatgaccagcttggtcgtttccaggggcttgacattagtagcaaaggatcaactctcgtgaagtctgaaggcccctcactctccgcaagtgagagtagcactacattttgaatttgacagaaaatgcttgacctgctgacttatccatgccattcattgttcatagggttgacatttagtcaactaatgaaggtaccttatttcatgattcaaatttgaggattaattttaactatttattctaagggggtgctcaccaaaaaggggaagcacccatggggttttgttgcaaagttcacgtaatcatgtttcagcatggcatttggtgtttctgggagctggaatattgggaatgaaaggtcattcccattgtatctttgtatttgtatcatcgtttacgtgatagcatgtaaactgtgtgatttattgttgtgtttcactacattcagagtccaagacggactctttttctttctttctataattacttagtttcaggtttattcatagtcgttgtacaatgcaagagttttgggtactccgtacgtgttgtattaagcttcttccgagatcagacctttttgaataactgacatttcttagtttctctgttctgatttctttgtaacacattactatctttgtagtacaacacttttgattgtaccaactaccaagtatgtttagccaccctaaaagttaagtattgtatcagtaattatcctttatgtattagtatttagtattcggacacgttatgacctgtttagtttattaggcttgagtcatttgacacctatattgctgtatatga

SEQ ID NO: 218 - DNA, 4695 bp, Glycine max
  misc_feature (1)..(4695): Glyma.08g194600.1
atatgcctgaacaaagggcgtgccgtactcaagtttctttcttgaagtatttgtcctgttactaagaggctgctttgcagcaaaaaagatatcattcaaattcaagttccaaaaatggcttactttgggaacataatagatgatttctcagggatttgtctgaaggattttgatttcacttctttctgttctcaaaggaccacaatagatgctataaatctactttttatctgtgtcttctacacctctatgattatcagtttaatgagaagaaattctcagtgtggtagtcccagcaaaagcaggtttttcattcttgtctctatctgctgtgctattattagcattgtgttttacagtattggcttgagaaatctcatagccaaaactgataactctaagcagctgaactggttagcttgcattgtcagaggattcatttggacttctttggcagtttctttgcttgttcagagactcaaatggatcaaaattcttaactctgtctggtgggcatgttcctgtgtactggcttcagttctaaacattgaaattctgtttaaaaagcaagcaatagaaatttttgatatcatacaatggtttttacactttcttcttctcttctgtgccttccaaaatcttggttactttgtctctcaaagtgtgccacaaagtttatctgagccactcttagaccaagaagttgacactaaacaaacaggactaggccgtgctaactttctcagcaaattgactttctcttggattaattccttactcagtcttggttactcaaagtcactagttcttgaagacatcccttcccttctttctgaagatgaagcaaacttaggctaccaaaactttatgcatgcatgggaatcccttgtaagggagaggagcaagaccaataccaaaaacttggttctttggtctgttgttagaactcacttaaaagagaacatattaatagctttttgggcactactcagaacctttgccgtttctgtttctcctttaatactctatgcttttgtaaactactcaaatagtagggatgccaagaatacaaatctcaaagaaggtctttccatagttggttttcttattctctccaaagtggttgaatctttgtcccagagacattggtttttttattccaggaggtcaggattgaggatgagatcagctctgatggttgcagtgtatagaaaacagctaaagctttctagctcagcaaggagaaggcactcagcaggtgaaattgtgaattacattgcagttgatgcgtatcgtatgggagaatttccatggtggtttcatatagcatggacatctacattgcaacttgtcctatctattggtatccttttcggtgttgtgggtgttggtgttcttcctggtttagtccctcttcttatatgtggacttatcaattttccatttgccaaaatcctacagaattgtatggcacagttcatgatttcacaggatgagcgtcttagatcaacttcagaaattctaaatagcatgaaaatcattaagttacaatcctgggaggacaaattcaagaatttggttgagaacctacgtgctaaagagttcatctggctgtctaaggcacagatcatgaaagcttatggttcatttctatattggatgtctcctaccattgtttcagctgttgttttcctcggctgtgctcttttcaatagtgccccattgaatgctgggaccattttcacagttcttgcaatgttgaggaacttgggagaacctgttcgaatgattccggaggctctttctattatgatccaagttaaggtctcctttgatcgtctcaataccattttgcttgatgaagagttagacggaagcgatggtaacagaagaaatataaaccgaagttcaataaatgcggtggaaattcaagctggtaacttcgtttgggatcatgaatcagtgtccccaactttaagagatttgaatttagaaatcaaatggggacagaaagttgcagtttgtggaccagttggagctggaaaatcatcccttttgtatgctgtacttggagaggttcccaagatctcaggaactgttaatgtgtgtggcaccatagcctatgtttctcaaacttcttggatacaaggtgggacagttcaagataatatactcttcggcaagccaatggacaaaacaagatatgagaatgccattaaagtttgtgctttagataaagatattgaagactttagccatggtgatcttacagaaataggtcagcgagggattaacatgagtggaggacaaaagcaaaggattcaactagctcgtgcagtctacaatgacgctgacatctatctcctcgatgaccctttcagcgcagttgatgctcacactgctgctattctgttcaatgactgtgtaatgacggctctaagagaaaaaacagtcattctagtgactcatcaagtggagtttctctcagaagttgatacaatcctggtaatggaagatggaaaagttactcaatcaggcaattacgagaatctcctgactgctgggacagcctttgaacaacttgtgagggctcataaggaagcaattacagagttggatcaaaataatgaaaagggaactcataaagaagagtctcaaggttatctcactaaaaaccaaagtgagggagagatttctaccgagggtaaacttggggtacagcttacccaagaagaagaaaaacagattggtgatgttggctggaagacattctgggattatatttcattttccaggggttcattgatgctgtgttggatcatgttgggacaatctgcttttattgctttgcagactgcatcaatgttttggcttgctctagccattgaagttccaaaaataactagcgccatcttgattggagtttatgcattaatttcattttctagtgctgggtttgtatatgtaagatctctctttactgctcaccttgggttaaaagcttctacagccttcttcaacagtttcacaactgctatcttcaatgctcctatgttgttctttgactcaacccctgtgggaaggattttaacccgagcttcatcagatttaagtattttggactttgatataccttattccatcacctttgtagcatctgtaggacttgaaataatggtgacgatttgtataatggctttagtaacatggccagttctcattgttgccattcctgcaatggttgcatcaaaatatgttcagggatattatcaagcctcagcaagggaattaatgaggatcaatggaaccacaaaagctcctgtcatgaattttgcagccgagacatcacttggtgtggttactgtaagagcatttaacatgacagaaattttttttaggaattacttaaagcttgtggacacagacgcagcactgttctttcattctaatgtggccatggaatggttagttttaaggattgaagcacttcaaaatttgacggtcattacttcagctttgttacttatcatagttcctcagggatatgtgacctcaggccttgtgggactgtctctctcttatgctttctccttgacaggatctcaaatattttggactcgatggtattgcaacttattaaactacattatctctgttgaaagaatcaagcaattcatccacctaccagtggagcctccagccatcttggaggaccaccggcctccatcttcatggccttcaaaaggcaggattgatcttcaagccttagagattagatatcgtcccaatgctccattggtgcttaagggcatcacttgtacttttaaagaaggtagtagagtgggagtcgtaggaaggactggaagtggaaaaagtacactcataagtgctttgtttcgcttagttgatccagcaaaaggttatattcttatagatgggattaacatatgctcaattgggttgaaggatttgagaatgaagctaagcatcatccctcaagaaccaactcttttcaagggcagcattaggaccaacttggaccctctaggcctgtactcagatgatgaaatatgggaggctttagagaaatgtcagctcaaggaaactatcagccgtctaccaaatctcttggactcttctgtgagtgatgagggaggaaattggagcttgggacagcgccaactgttttgtcttggaagagtactacttaagaggaacagaattcttgttctagatgaagctaccgcatccattgactccgccacagatgccattctacaacaaataattagacaagaatttgtagaatgcacggttataactgtggctcacagggttccaactgtaatagatagtgacatggtcatggtcctctcctatgggaaattggtggaatatgaggagccttcaagactaatggagaccaactcctcattctcgaagctggtagctgaatattggtccagctgcaggaagaattcttcctcaaatcttagcagacagcaacattgaataatgaataataacattatggaaaatcacgtgcagacttactttttcactgttttacttttaaaataatctacctgatgcagagttatatatctttataaactccccttcaacatttgtcgatttttttcttggtttgttaagccatgataatttgaagaactgcagcatttttaactagaa

SEQ ID NO: 219 - DNA, 2061 bp, Glycine max
  misc_feature (1)..(2061): Glyma.08g096300.1
catcatcgtccacaagaaaaagaggtggtgctggcgatggaaactatgctcacaacaagtgacagagacagagtagaaccaaaagattcataataactaacattagaaactaggtgaaagtaactgcacagacacacaacacatcttccttaatttctccgtccatttccctcccataaataaatctttcatttccatctttcttgggtgatccaatggcgacccttttccagggattgggagttgtgaacccatcattggcttcttcaaactccaacaagttccatcttccttctcgtacatccctctcagagaggaaagatggcatttttgtggtcagatctgatgcaacaagggtaagcagccaggttctgaaggctggagctcgtaagcatgaattgttagttactaatgcagttgcaacaaaggaaggccgtcctgcggcttctacatcaaaatctgggcatgaacttctcctttttgaggccctacgtgaaggtttggaagaagaaatggagagggatccttgtgtatgtgtcatgggcgaagatgtaggtcactatggaggatcctacaaggtgactaaaggtcttgccacaaagtttggggaccttagagttttggacacccctattgctgagaactccttcacgggcatgggcattggggctgccatgactggtctgaggccagttgttgagggcatgaacatgggattcctacttctggcatttaaccagatctctaacaattgtggcatgctccattacacatctggaggccagttcaagataccaatcgtcattcgtggacctggtggagttgggcggcaacttggagcagaacactcgcagcgattggagtcgtattttcagtcaatccctggaatccagatggtggcttgctcaaccccttacaatgccaagggcttgatgaaagctgcaatccggagtgagaaccctgtgattcttttcgagcatgttttgctttataacctcaaggagagaattccagatgaagagtatgtattgtcactcgaagaagctgaaatggttaggcctggggagcatgtcacgatattaacctattccaggatgaggtatcatgtcatgcaagctgctaagacactggtgaacaaagggtatgaccctgaagtaattgatatcaggtctttgaaaccattcgatcttcacacaattgggaattcggtgaagaagacacatcgtgtgctaattgtggaagagtgtatgcgaacaggtggaattggtgctagtttgacagctgctattactgaaaatttccatgactatttggatgcccctatagtatgtttatcctctcaggatgtgccaactccttatgctggaacattggaggaatggacagtggttcaacctgctcaaattgtgactgcagtcgagcagctctgcaagtgatttctacaaaacactagcaattaggatatggtttttggtaaagctattgtgcttgttaaattaagcttgaattttcattataattttctcttttcctattatttctgaagtctaaagcccataactttaaattgttgtttaatttccgatattcttttgcgtttttttatttataaaaagagtatttagaactgccaacccaatctaaatctttctcagcttgttcatctgcataatttatgtggtgtgtgtgtaagagttaggccaagccttataactagggagatatttgtagtcagtgctgaactgctgaagcaagcaaatatctgttataaaccttgtttattttgaattaactcttttggatgtagttcttacagattttgaatatgctattcaatcctagtgtcaggcttctgagttctcgtgttctaattggaagttttcgtgtcagtttcatatattatatatagtttagttagtaatagccgtgggattgcactacttctaaatattcacctgcacgaaacagctaaaatttttgtattcacgtaataatatcttatgcgtatttattatcttgacgataataattgaggaaattcagtatttgctattacgcttc

SEQ ID NO: 220 - DNA, 2257 bp, Glycine max
  misc_feature (1)..(2257): Glyma.17g226600.1
ccattttcacttttaccctcaaaagattatttttgaattgaatcctctttgaccctttccctgtccaaagcatattcccctctcttctttaattcccttttcctttccctttctcttctcaacaacaataacatcgccaatattcacgtcgcgattcgcgaaaacccgaaaagcttaatcgcttcgtgttcagttctccgatccaaacagaaccttattattatcattcccctttccgttttctcgttctcctttcagtttcagcgagaaaacgaaaacgaaaacgcgcttcgttcgatcgcgtgcgtgcgtcgcaatgaacaacgatttcgtttggcttccttcgctgtattccgatccggaactattcacctatctggagccattcgtgttccgcagttctccgagctcgcatttcctgcaatcgatggcgaacaattccagaagcttcgcgctcgaggaggcgttcggacacgtgtcgcggttcgccggcgcgttgctgttctggctctcgcgcgcgtcgagttccaatttggcgcgttcgctgcgcggttcttctccgccgcttcggttcggtagcgtgcaggttaaggctgtgtcgacgaatgtgcgcgtgttcgggtttccgttcggattgaagaggaaatcgtcgtttgcgagtgtgaggttggggaagatttctagtttggcgatgaggatgatttggagagaagcgaagaggcttcgctcgttccctgttctgtcgctggcggctgcgttggttccaccgtttcaaaacttgtcatcaaatgtactatctagcccgttgcagaatcctgatgtgcaaatgtttggagccatggaccaagtgcctaaggaggttgaatgccaaggatgtgcattcctaccgtgtcttgagttgaaccaggcaaaacctgcagtggagcctaagactggtattgaatttcctttggttctagacaatatattcactggagagaagaattatgacttcaactctgaggtcctggttggaacaggatccagaaccatgacaattgttaaaatcaagtcactgaaggtctatgcttttggagtttatgttcatccatattccctctgtgagaaattggggccgaaatatgcatcaatttctgctgatgaattgaataaccatcatgacttctataaggatcttctcagggaggatattaatatgactgttagacttgttgtaaattgcaggggcatgaaaattaacagcgtgaaggatgcttttgaaaaatcacttcgagctcgattagtaaagacaaatccatccacggactttagctgcctaaagacatttggttcatacttcacagagaatttctcaattcctttgggaacgataattgagttcaaacgaacagttgatggacgtctgatcactaaaattagtggcaatcagataggaagtgtccactgcaaagatttgtgccgggctttctttgacatgtacattggagatgtccctgtgtgtgaacaaactaaaaaggagattggcatgaatgctgcgaatattattaggaagtgctaaaacaattcattttctatccacttgtcctacttttagaatggacaattggacatggatagcatggcaaattggcgtatacccttaacttataatagaagcagtggtttcttgaaattgatttcaacctgcttttaaaatcattcgctggcattacttccccaggtgtgtcctttgaatcatagaagtctttaggatagcttaaattggattttcattggaaaattctttctgttcctattgactatatcattatattcatcgccttgatgcccccctatccctcatgttagatgtactcatattttagagaatgaaaaggaaaaaaaatgcagataagaatgtttgtgcccgtttgctcaagcaaataagtatttgctaccttttatattcagtatagtaatgtgtttaactagcatttctcgttgatacaatcaggaaatgctatgcaaagtaggtttagattctattgacttggcagcatttctggttggagaatgtatgaaactttaagcgtgtgtttggagcggtgtttttaacgctcatgctccaatttttcacgtcaaaattgtataagacttaaaagttaaagagagaagctttgaactgaacacagatcacattggtggttgatgcgtaactgtagtggacacataactaaacacatggtagatgtgttgtcctttaaaaaaacgtgagtgg

SEQ ID NO: 221 - DNA, 2079 bp, Glycine max
  misc_feature (1)..(2079): Glyma.14g097800.1
ggattctgtaaaacagtggtaccgtgacgagctgcgagctcgatggaggcggaatggtgagcctgaacgtggcggcgaggttcccttcgcgctttgatctaaattatattaacgccaaaagaggcacggcaatggcttcaggggaccaaaaggcaccaccccaaacccaaaggttgcaaatttatcccaatacaaattctggggtctcacctttctggagagaaaagtacgaaagagaagccaagaggtattgggatgttttctacaagcgccacaaggacagattttttaaagatcggcactacttggataaggaatggggcgaatacttttctgggggaggaagaaaagtgattttggaggttggctgtggagctggaaatactatctttcctgtcatagcatcaaatccagatgcttttgtttatgcatgtgatttctcaccacgagctattgagttggttaagacacatgaagacttcaaggaatcccatgttagtgcttttgtctctgatttgacagctgatgatctgtgcaacgagattcttccatcttcagttgatattgttacaatgatatttatgttgtctgcagtgtccccagaaaagatgcctttagttttgcaaaatattagaaaagttatcaagccaaatggatatgtgttgttccgagactatgctactggagaccttgctcaggaaaggttctctagcaaggatcaaaagattagtgataacttttatgttagaggtgatggcactcgtgcttactatttttcaaatgagttcttgacaaatttattcaaagaaaatggttttgatgttcacaaacatcatgtatactgcaaacaagttgagaaccgctcaagggagttgataatgaatcggcgttgggtccaagctgtatttcgtgtatcagatagttccaactcctcttcatgtataggagccgaggccaatcatcttgacagtggtaatgacaataaagaaatcaagaaaaacagtttgaatggtggtttaaatgattctgcagttgacttgtctgagggtgtggcagttgacatgtttggagtcttaccttccaacgagtatgagattattgagatcaaccttagaggctggaatttcaagattagtttactttcaaaagagtaccagcatacctgcaagtcaacaggtttgatgctgtgggaatcggctcggttgatggcgtctatccttgcagaaaatcccaacattgttgcaggaaaaagggtcttggagttggggtgtggcagtgggggaatctgctccatgattgctgctagagatgctgatctagtagttgcaactgatggagatggctttacacttgatatcctgaccaaaaatgttgcatccaacattgagccatcattactgactaagctaaccacaaaaaaactggagtggggaaacaaggaccacattgaaagcataaaggaagtagtgagcaatggagggtttgatgtcatcattggcacagatgtgacatatattcctgatgctatattgccattgtttgcaactgctaaagaactgattgctcccagtggaaacaaggaagatgataatgttcctgcacttattctttgccacatctttcgccgagtagacgaaccaaccttactttcggctgcagcccatttcgggtttagattagtggacaagtggcctgctggaacttcaactaatttgtctcatagaattattggcaattggtttgttgacaatgatttaaaggatgatcttcctagtacagcattaaacatcttgctcttctgcaaggagtgatattgaacaacttgattcttctcttcattactattaaaagtgagaagtagaatgtaatttcctagttgattcatttaagtactcgacaatccgtgtgggctcatttttgtaagtttttggtggagagttctgttttatttatttatttataaattttgtagctttgctcccccacttgggggccttagacacggacacgtgatagttatgcaccctgcatcatttgctaggaaatgcaaaaggaccactttctgagtttttgtttagt

SEQ ID NO: 222 - DNA, 3249 bp, Glycine max
  misc_feature (1)..(3249): Glyma.19g064200.1
aattaatagcccccataaatagaagtacaactagaacacacaaaaaaagactcaacagtggtttatgattgggtaaatttgggttttccagtgcgaaattggcctcaaggtcaaggaaagcgtggtgactggtgagttgaagttgaaggaagcgaatatgcgtggagcgaaataggaagattcttgcgtaagcagcatcttcctctctcttattctattcccttattttccctttttgtttcttatttctcaaaattcaaagaacctgaaatcaaccacaaccttctcctatatataatacacacttctgcattgctattccttctcagcattctccttagcctcaggttctctctctctctctctctctctcttagttctcacaattcacaaaacacaggttgtgaacttttattttcttcttctttgtggttgtttgttagttgaggcctcttcatgtttttgcggttgctggagtttttaattaaagggaaattctggggtcaaattgtaaatgttgtgaacaatattttcttcttttaaattagtaaatattgttgacgagttgagactcgcgatgctatgcggttatcttaattactgcaaggttgaaggaatatggatggggtttagctttatgagaactgaataaaaaaaaatacccaatgacattttagattgtattctagagcaaattagattatctctccgtataattaggaatgagagtttatggtataggtatataagtaggaattagtttttgagattaatttctgtgcattgatcgtgtaatttgacacttttgttggtgtgacttttaagatagtcattataaaagttaacaaaattatcttaatgttattttgttattggataacagtgtaaaaactttttagattgtcatttcatacaccatctactcttgttttttttgtcttttataacactaacacatcatatatctcattgcattgcatcgatacacattgcaaactatgatattcttatattccttttctacctgaacccagtgttgttaaatagcagccatggcaccaccatggtggaatggcatggcggattttttgccaaccaccacaggcaatttgtgaagggaggcctgccatggtggcaccatgaggtgcaatgacgtgtttatatggtggaattttagccttctgtcatgttctgccattgataacactgcctggacccctatcaataatttcaacacaaaatcaatgcaccagtgaacgagcataattttggtgtatctgaatgcattggatttattcataagaggaaatttgtcaacaattggctagctgtgaatttgtcaacacattaacagtacttgcatgcttatggtgcatagctgctaggagattttgtttttgttgttttaattgtgacaatttgaagagatataatgtgagaaagactgcatgtcagctatctgaaattctgaattggaaatttttatgaattcagggatactcatctcatgattttatataggactgggaggaggaaatctgagttatacaaccatacattgatggttaagattaaatgttatgtaatttatagaagtcatttaatttttttaagttggaagtcaacctaattttgaacatggcgaattaattacaagttacaacaaatagtggaaggtcacctgagttaaattcttatatgatctgttatatactcattgtaatatgcagttctttgtgcttgtatgttaaaatttgcttgtggttgaatgttaaaactacatgcatactggctccaaattttatgaattactaatattctatttgtaaggcagcattgttggctagcacttaacactttccaaccaatcagtaccagcaacttcttgctggtactcaagttgtcctgcatcttctgtgggggatgacatgactcaaaacagcatactgaatcacagtagagctcttgagggtgtccatggggtccaagtggcccctaactcgccatttgatttgacagaaactaatcaaagtggggactttcgtacttcaactggtggagcatcaactacagaagcaaatcagctgctgttgatgcaaagactatggcaacagagaccagcatgcttgagacccatccattgtggtattagttgtcacggtgatcagactcttgctgaaacagttgctaatgtgcttacttcaattccttttatagctcttggaatccatgcccccaggaagaatctcaattctaagttgtatgctaattcactaattggagttggagtggcctcaagcatttaccattcttcaagaggaaggttgaggaaatttttgagatgggttgactacacaatgatagccacaacaactatttgtttgtcaatggccctccgaaatgagaatccaaagttactgatggcagcatctgcaatatgtcttccagttaatccaatgatggtttcagttattcacactgggatgatggaggctgtgataaggggagattatttttggttgtgcgatccaaccagtttgccatgtagtcactgtacaattccacttccatcttgccatagaaatggatttcattacatctgaagatcatgggtgtgcacctttctctgtatgatctcactcaatccatttataaaacgccctgaagcaactgcgctagaaatttctggtagcatttgctagaagggcattgaaggatccagacttgagaatggctcacacagtgcataagacatcgtcgttacttggtggtatgctttttgtagctgatgatttatttcctaaaactccttaccttcatgctgcatggcatcttgctgctgctgttggtgtaggcacctgcaataagcttcttgagtaggtgtgcacactctattcgaaagctggaaactatgcattctgagtaagaatagcatcagcataatctgtcgacttaatttgtagaagcaatggttaagatcataaggtagtacattgtattttattggattcggttgaggatgtagatatgcaaattaggttccaaattattctacccctcttcaatttgtagttttatgttcattagttaaactcattggagaaagcgattcatgcagcaaaaatctggcacctattcttctccttagataaacatgcagttatatataaaacatcgtgcattataattctatctgaacatgtatgttgagatactatggagactcttgactttttagtttgaagtgtg

SEQ ID NO: 223 - DNA, 2461 bp, Glycine max
  misc_feature (1)..(2461): Glyma.13g367200.1
ttaaaatgttgttatttaaatgtttttgtgcagcttgagcgaaaaattttgcacgtgggagatgaaatgaaacctccttcaattcctttttcaatcttcatggcggatacaacactccagtctagctgttaatgttaaattaaaaccgatacttagccgctaatttgcttggaccacatggtgatcgagtttaccgattacgtaatgatcaaattatgtgtagtacactcaatcaatcacatgaagaatcaaaacacaagttcaagttggtagttacgtgtacgaagagaaatggcatcttactcaaaaacaaaaacagttgttattcgcattgaagcaataagcaatggtaactgcagcatgtcagtcaggacgtgtgagtttcaaacatccttcttctcatttccacttacctcaatgtccatccttgttggacttgtgcatccgcaaaatcactcacactctgactcgggaggacatacataaatataacactttttctgcactcccaccggacttgagtcagcgaattttcaacaatatggtttactcctcctatctcacacctgcttccctccaaccctttcgagattctgccctccaggatatttgcttgggagaatatgaatatgcaaatggtggtggtgctgctgctgcaattgtggatgatgcctggatggatgtcatctcatcacagggatcctctttacttcatctagatctttctgcctctgatgtcactgatcatggtctcacctttcttggacattgcacaaatatcatctctttaaatcttaatcactgtcaccaaatttcagatcatggactagagtgcatcagcggtctctccaacttggcaagtttgagttttagaagaaactatgcaatatctgctcaaggattgaataccttttctggtcttattaacttggtcaagttggatttggagagatgtcctgggattcacggaagcctagttcatattcaaggtttaaccatgttggaatctctcaacctaaattggtgtaactgcttagtagatgttgatatgaagcctctatcagtgcttacaaacttgaaaagcctagagatttccttcaataaggtcacagattttgggatcagttttctgaaaggattacaaaagcttaatttgttaaatttggaaggctgccaagtaacaactgcatgcttggactctcttgaagagcttcctgccctgtcaaacttgaatcttagtagatgtaatctttctaacgatggatgtgaaaagttttcacgactggaaaatttgaaagtattaaacttgggatttaatgacataacagatgcatgtttagcacacttgaaaggattgacaaagttgaagagcttgaacctggattcatgtaggattgaagatgaagggttggtccacctggcaggtcatcagcaactgaattgcttggaactctctgatacgggaattggaagcaatggactacatcatttatcaggattgtctaatctggagaaaataaatctatcgttcacttttgttaatgatagtggtttaagcaaactgtgtggactctcatctcttaagtcactaaatttggatgctcgccaagttaccgatactggattggcatccttaacaagtttgactgggcttacagaactggatttgtttggtgcacgaataacagattttggaacaaactatttaaaatgcttcaagaacctaaggttgctggaaatatgcggtggagaattgactgatgatggtgtgaaaaatatcaaagaactttcatctctgaagagcttaaatttatcacaaaactgcaaccttacagacactaccctggagttaatttctgggcttactgatttgatttctttgaacgtttcaaattctggtatcacaaatgctgggctgcagcatttgaaaacactcaagaatttgaggtctctatcattggagtcctgtaaggtgacagcaaatggcattaagaaacttcaatcaacagacctccccaatctggtaagcttccggccacagtaattggggaggtatccccaacatgttgtagtctatattaagaatctctatttgcactggcatacctcagaaaaagtatggaaagacgacctcaaattgaatatactatgtatatataggctaatgccttcaagagaagttagaattattattgcctcttaatttggttcgaagctttctttaattttatattgaagtatgcctagagcttttatatttcaactttcaagtgggtctgtgtagaagtgtatagaacgtaaatcagcatgcactattccataaacaaaatggtgtaaactatttgtaattggtccaatattttcaaattgatttttttcgcctgtatagcagttaacgagtttggccattctgatcaatctctgaaagaacaaaaccatctttatgtactagaggaaaaaa

SEQ ID NO: 224 - DNA, 2808 bp, Glycine max
  misc_feature (1)..(2808): Glyma.04g221900.1
atgctccacaacaagtccttcgtcaagaaaaccaaaggtggcaaagtcataaagcaagtgcgggagcactacctgcgcgacgatatatactgtggcgcaccgttttgcaccgtttgcgattcttccagtgctcgcctcagtgcttcgccttccatcattctcgtcgtcgacaccaatgtcgttctcaaccagattgatttgctggagaatccggcaattgacgatgttgtggtgttgtccattgtgttggaagaggttaagaacaagaacatgtctgtttacaaccgtataagagctatctgtagcaattccatgaggaagttctttgttttttccaatgaataccacagggatacatatattaaggaaatgagtggggaaactaaaaatgataggaatgatagagctattcgagtggctactcagtggtatcagaatcatcttggtggtgcagtaaaggtgttgcttttaactaatgacaaagagaacaaaaggaaggctagtgaagagggtattttggccgaaacagttgagtcatatgtgaagtctttggaccaacctgatttacttgatctgcttgtgcggcctgcatctgaagatgtggacatggaagaggttgaagatcttagaccatccaagaggaaagtcatctactccgagcataagccgatgtcagaaattacttctggtttgcatcgtggaatatatcatcaagggaaacttcgtgttaaccgttataatccatttgaagcatatgttgggagtgagagcattggtgatgaaataattatttatgggcgctcaaacatgaatcgagcatttgatggggatattgtggcagctgaacttctgcctcaggaccagtggcaaggagtctcatctctatctatagcccatgaagaagacgaggatgaggatgaagatgttcatctagctccaaatagtgctgatgatgcacctagaactatttctcagcagggttcttctgaacaagtaaatgctgtgcccagtcgtccttctggtcgtattgttggcattataaagagaaactggcattcgtattgtggatctttggagccaatgcctatgcctgcagggagtggtggtattgcccatgccttgtttgtctccaaagatcgcagaattcccaagattcgaatccaaacccgtcaacttgagaaccttttggataagaggattattgtggcagttgattcttgggatcgtcagtctcgatatccatcaggccattatgtgcgaactataggggagataggtgatagagatactgaaagcgaggtggttttgatagaaaatgatataaatacacggccattctcttcacaagtgctggcatgcttgccaccattgccatgggtagtctcttctgaagatttgtctaatccaatcaggaaggatttgcgtcatctgcgtgtcttcagtgtggaccctccaggctgcaaggatattgatgatgcactccactgtcacgtccttccaaatggaaactttgaagttggagttcatattgctgatgtgactaattttgtttatcctggcactccccttgatgatgaggctgcacaaaggggtacgtctgtctaccttgttgagcggcggatagacatgcttcccaaacctcttacggaggacatatgttctcttcgttctgatgtggaaaggcttgcattctctgtcatatgggaaatgacacccgaagcagatattattgccacctcatacacaaaaagtgtcataaaatcttctgcggcattgtcttatgttgaagcacaggcaaggatggacgatagtcgattgatggatccgattactgcagatttgaggaatatgaatagtttagctaagaaaatgagattaaggcgtattgagagaggagctttgactcttgcatctgctgaggtcaaatttcaaattgacacggagactcatgatccacttgatattggaatgtaccagatccgggaggccaaccaaatggtggaggagtttatgcttgcagctaatgtttccgttgcacaacaaattcttaaaagttttccattgtgctcattattaaggcgtcatccaacaccaacaagagagatgcttgaacccttactacggactgctgctgcagttggcttgcacttggatgtctcgtcatcaaaagcgttggctgattctcttgaccatgctgtgggtgatgatccatacttcaataagttaatccgtatactggcaactaggtgcatgactcaggcagtttatttctgcagtggggatcttagccctccagaatatcatcattatgggcttgcagctcttttgtatacccatttcacatcacctataagaagatatgcagtagatgtcattgtgcacaggctacttgctgcttctttagggatatccaagttaccacctgtatttcaagacagtctccagctcactagtattgcagacaatttaaattatcggcacaggaatgcccagtatgcagggcgggcatctgtagagctacatactctaatttatttcaggaagaggcctacagacacggagggtagaatagtgaaaataagatctaatggattttttgtgtttgttcccaaatatggcatagaaggacctgtatatttgacaaaagcagaaaagggaagtggagaatggtatgtagatgagcaacagcagaagattaaaaagatggatggtagcctttcatacaacgttttgcagacagtccaaattcacatggaggttgtggagcctcagcctaaccggccaaaacttcagcttaccctcatctag

SEQ ID NO: 225 - DNA, 5484 bp, Glycine max
  misc_feature (1)..(5484): Glyma.17g104100.1
acacacaatcattctactggtcagtcttagtgagcgagcgtgttcactaaggtaactctttatcactcttttcttcgctgactccattatcaacgttttgaacaaaactctctctcttgttattattattcttctttttctcttttcactctcctttgtttgtcctttgaacccacccgtgaaccctccttcaaccgtcatcgttttgatcacatacacccactcttaaaccttcaaactctcttcgccttgggtaatgccggacggagaatcctccgtcgtcgtcgccggcggccaagcttccatggaaccctccttaagcgtctccaatcaactgcagtccctgagtctttcccaagacaaaaaccatgatgactcagtcaagaaagatccccggaaaattgcaagaaagtatcagttggagttatgcaaaaaagctatggaggaaaatataattgtgtatttagggacagggtgtgggaagacccacattgctgtgcttcttatgtatgggatgggtcatttgattcggaaaccgcagaagaacatatgtgtctttcttgcccctactgtggctttagtccatcagcaagcaaaggttatagcagactctactaattttaaggttgggacatactgtggaagttccaagcgcttgaaacgtcatcaagactgggagcaggagattggacaatatgaggttcttgttatgaccccacaaatattacttcataacttatctcattgcttcatcacaatggagatgattgcacttttgatatttgatgaatgccatcatgctcaagtcaaaagcaaccatgcttatgcagttatcatgaaagtcttctacaaaagtaattcctcaaaggttccccgtatatttggcatgactgcttcccctgttgtaggaaaaggtgcttctagtgaagcaaatctagcaaaaagcatcaatagtcttgaacatatacttgatgctaaggtatactctgttgaagacaaggaattgcaatcttttgtgaccactcctgtgattaatatatatcattatgtttcaactgcaagtggggaaactagcttgtacctgaaaattgaggagattaaacgccagtgcatagcaaaccttggtaggagtatagaagatcaccagaaaaggatgaatgcaaagaaacttctgaaccggatgcatgataatgtgattttcggtctgcagaatcttggcatttggggagcattgcaagctagtcatattcttctgagtggtgatcgttctgagaggcatgagttagtggaggctgaaggaaattcaagtgatgactctctgtgtgataaatatcttgctcaggctgctgaactgtttacttcacaatgcatgataggcgacagggtaactgatttatcttctgtggaaatattaaaagagccatttttctcagcaaagcttttacgactcattgggatattatccaactttaggttgcaaaagaacatgaaatgtataatttttgtgaatagaattgtgacagcaagatccctgtcatacattctacagaagctcaagcttctaagacaatggaggagtgatttcctagtaggagtccatgctggactgaagagtatgtcacgaaagaccatgaacatcattgttgataagtttcgctctggagagttgaatctactggttgcaaccaaagtgggtgaagaaggacttgacattcagacgtgttgcctcgtcatacgatttgatcttccagaaactgttgccagctttatacagtcaagaggtcgtgcacgtatgcctcagtcagaatatgcatttttggtggacagtggcaataagaaggaacttgacataattgatggctttgagaaagatgaataccgaatgaatatggaaattacttttcgaacatccaaggagacatacataatccctgaggaaagaatattcagagttgattcgtctggtgcttctgttagttctggatatagtatctcattgcttcaccagtattgttcaaagcttccacatgatgagtactttgaccccaagccatgtttttattacttagatgattcaggggggatttcctgccatataacattgccttccaatgcaccaataaaccaaattttaggtacaccacagttgtctatggaggcttccaaaagagatgcttgcctgaaagcaatagaagaactgtataatttaggcactttaagtgattgtctcttgccaaaacaagatgatgcagagccagaggcgcaggtttcaggctcttctgatgaagatgaatgtgaagatgccatatcaagaggagaattacatgagatgctagttccttctgcctttggacagtcatggataaatgaggataacatcgtccgtctcaactcttactacataaaattttgtccctatccagaggatagggtctacaaagagtttggtcttttcatcatggttcggcttccaatggaggctgagaaattggaacttgatctccatcttgctcatggtcgatctgtgatgacaaaatttgtcccatttggagttgtagaatttgacaaagatgagattaagatggcagagaattttcaagaaatgttcctcaaaattattcttgatagattagaattcgtttctgagtttgtagacttgggtatgggtgctgaatctcacacaggcacatcaaccttctaccttttgcttccagttgtattgcaagaatatggaaatgccatgaaagtagactggaagactgtgaagagatgcctttgttcaccaattttcaggcatccagctgatactatggataaaaaagttttccctttagatattcacctgcaacttgccaatggttacagaagtgtaagagatgtcgagaatagtttagtgtatgccccacataagaagaacttttattttgtcacgaatgttaactaccaaaagaatggatatagtcctcataatgattcaggcacttcaagctatgtggattacttcattgaaaagttttccattcacctcaaatgtccagaacaaccacttctacatgttaaaccagtctccaatttgcacaacctgctacacaaccgaaagcatgaggatgcagaaccacaggagctggacgaatacttaatttatttgcctcctgagctttgtgaactaaaaataataggtttttcgaaggatattggcagttccatatctttgctaccttcaattatgcaccgtcttggaaacttgctggtggctattgaactaaagcacaggctatcttcttcctttccagaggcagctgaaattagtgcccttagagttttagaagctctcactactgagaagtgtcaggagcgcttttcccttgaaagacttgaagtgcttggtgatgcttttcttaaatttgctgttgcacgtcatttttttctcatgcatgacagccttcatgaaggagaccttacaaaaaggcgctccaacgctgtgaataattccaatctgtttaagttggctatcaagcgcaatttgcaggtctatatatgcgatcagacatttgatcccactcagttttatgcattaggccgtccttgcccaagactttgtagcaatgaaaccaaagaaagcatacacttctgtttaaattctgttaaggaacaaggaaaagtaactgaaacccaatgtaacaaaaatcatcattggttacataggaaaacaattgctgatgtggttgaagctctggttggagcatttctagttgacagtggctttaaagctgcaattgcttttctttcatggattggcattcaagttgattttgaagcttcacaagtggttgatatttgcatagcaagtgctagttatttacctctttcttctgaagtagacattccttctcttgaaggtaagctaggacatcacttttttcataagggcctgcttctccaggcatttgtacatccttcttacaataagcttggaggaggctgttatcagcgattggagtttcttggagatgctgtcttggattatttgattacttcatatgtattctcagcttatcccaaactaaagcctggtcaattgacagatttgagatcattgtctgttaacaacaaggcatttgcttgtctagcggtagatcgcagttttgataaatttcttttatgtgattcaagtggcctgtctgaggcaataaaaaagtatgttgactacattagaagacctgtatcagataacagcattaaagaagggccaaaatgtcccaaggcactgggtgacttagtggaatcttgtgttggtgccatccttcttgattcagggttcaatttgaacaaagtttggaagattatgacttcgttcttggactcaatcatgaaattctcatcaagcttgcagctcagtcctgttagggatttgcgagaactttgccaatctcataatatggagttggagtttctgccagtgccctcaaaattgactaaaaggttttcagttgaagctaaagtgagtgggaatggtgtatgtgaaacagcttcagcaactggtcaaaataaaaaagaggcttgcagaattgcttcactgctacttttttcaaagttcaaggctcaaggctggaaagcaaagtcaaaaactttggaagaagttctggaatcaacttctaaaatggaaccaaaacttattggctatgatgagactcccattgatgtaacagataccaataaacacatagtggttaatgcagacccatacaacaagtctaacccagaaattcgccctatgcaagagacagatgaaatatgctctccatgtgtgaaacctttcggccaacggcttcaatcttctgctaagggaaagcttagtcaaatatttgaaaatcgtgattgcagcagtgacttgtcagggacaggaacggcaagatcacgattgtatgaattatgtgcttcttattgttggaaacctccttcatttgaatgctgcaaggcagagggacctgaccacctgaaacaattcacttgcaaggtgaccttagagatagaagaggcccagaatttgattttagagtttgttggggaacctctttcaaagaagaaagatgcagcagagagtgcggcagagggtgcattttggtatctacaacatgaaggttacttgcctagtagtggtaattgacatattgtagaacaattatcatgtcacataaatcccaaggcaattggtgtaggcaatgtcttgattattgagggtgtcgaatgtgttgttataggtaatcatataatctagaaggcaataatagtacaggtttagtaactcagggccagggagggttccctaatggtaaatctattgtaaaggtattattcatgtatgtattattgtagtgtcaaagttacatctaacattgtatgtaaaccatccctcgattataacagtgaattttctatttactacgtttgaaatgtaaatataagctcgcgagacatttgacc

SEQ ID NO: 226 - DNA, 1885 bp, Glycine max
  misc_feature (1)..(1885): Glyma.10g102200.1
cggtgcttcccgatttcttctctttttattttaaggcgcaacgctattcttcactcaaacgaactgaaacgacatatcgcagaatcaagggtttcgtttcttccttcgcacctattcattcttctatctgcttgcaattattagcgccaaaataatcccaatgaatcggtcatcttccgtttcaaatttccgaaacctcacagtagctggcttagcatgatggattcaaacttaccatttctgcctcctagcaattccgatacaaaaaactcatttcgcaagccttctggtgatgcagctaataggaattatcagcatcggtcacctgttgacagatcaccctctcctgatgcttctaggcatggacatagctcaagtccaaatccagtgagagaaaattctgcaagagtctctcaccattcaaggaagtatgatgacagggaacacgaccaacagtatggaagaaatcactatggcagaagcagtgactctcttagacattctgatagacagtcattcaaaagttcctttggtcactctcggtatgacaagtatgcaaatgaagatagatatcgggagaggctgttgtctcgttctggacatgagtcaagggatgatcatgtgagagaagagagtgatagcaggccaaaaaactaccagtgcagtgtggacaagtattcacatgacaaatatgacaggtctgatcatagaagcaaagaaaaacgtagagatacatactcggagcatcagaaatataaagatatggattcttcatatgaaaaatctgcatctagcaagaggcatgcactgtatgatgaagtggagagggaggggcattcaagggactgggatggtcaaaatgaaagaagagattcccgccgaagttcaggggactacagaagtgaccaaagagatgagtcaggtccacaaagagacagtggtaaatttagtttaaaagaagcttataagagtgaacagaaggagtcaaatgatcaaaaccttccatgggaagaaaaaagaaaacatgatgacactgagattaggaagggcaaagactggaaaactagaaaagcaggcgagcagtgtgctattgaagacaaagaatcttctggaaagaaactaaagttgtttgatcctgacaaggatgacaattatagaaaagatgcagatgaaagtaagacttcaagttcaaacctttctcacaagagcaaggaagatttatgggctgtcaagtccagtggctttgatggtgacaatgatctagatgcggcgaaaattgcagccatgagagctgctgaattggttaataggaacttagttgggcctggatgcttgactactgaccaaaagaagaaactgttgtggggtggcaaaaagagtacacctactgaagagtctggccatcgatgggataccgggatgttttctgatcgtgagaggcaagagaaattcaacaaactcatgggtatgagaggcgaagcaaaggtggagcagaattccaacaaccaaagcagtaacgaaattctccgtgctgagaagcagaaggaacttcagatggatctagagaaacaatacactgcaggccttcgacgaagagatggccgtacagttggcttagggctttaaccattctccggaaaatttacatcctttgacatttatgtgttaattatcaccccatgtttagggaggagctttttgcttgtttgctgtggacatgcttgggagtttatgaatcttatgttagggacatcaccacttggcatctgtttggagttcctgattttgacagggcgtgttatttctatggaatttcttatcgtgattgtatctaaatttgtttttcatatgcaactggtttagataatttggtatttggttttct

SEQ ID NO: 227 - DNA, 3833 bp, Glycine max
  misc_feature (1)..(3833): Glyma.15g091000.1
tttctctctcccaaaaataatggcggttgcattgtgactgattggaggagagagagggtaaagctatagtagcattgccaccaagctagaagtagtagtagtagtaacatgaaatgaccaatgaccatgaccacaaagaataaccataaaaactaagcacaaacacaaccactgctacttctacttcccatttttccattaccggaaatctaacgagccaaacgctgactcttgattttgtactactactccttaccaacgctctttcctctctatcaaacaaacactgatcctttcacaccctctctctctccttggattcgctgttctttctctgagatctgtttgctttacgactctgttcctcttctgggtctcgttgctctttcagattgttgccaaacttggcagaaaaagccacttgtacttctgagagattctgttgtgcgtaacgaggactttcgttgaggactggaacctggggtgttgggggttaaggaaaactagaaccgaatgaggcgtactgcaattgtcttttcttgtgacactggttttggttgaaggttcatacgtgtgaatattaatggattgtaaggggcgtgaagtactggtacaaatataacagagaatgttattctgcagtgggaaggaagggagagaggaaaaggcttgttttgtggtggagggtgtcattttgtgagaatttcgttgcgtaattggtagtgttgtgattgtggactcgattttgaggttactaatttgctttagccttttttgctcaaatgagactttcttcagctgattttagtcctccaccccaggaaggggaaaaacgagttctagattcagaactttggcatgcatgtgctggtccccttgtctctttaccagcagttggaagccgcgtggtgtactttccacaaggtcacagtgaacaagtggctgtgtcaaccaacaaggaagtagatgctcatatcccaaactatccaagcttgcctcctcaactcatttgtcaacttcataatatgactatgcacgctgatgttgagactgatgaagtgtacgctcagatgaccttgcaacctctgaatcctcaagagcaaaatgaggcataccttccagcagagttgggcactgcaagcaaacagccaacaaactatttctgcaaaactttgaccgccagtgacacaagcactcatgggggattctctgtgcctcgccgggcagctgaaaaagtgtttcctccattggatttctctcaacagcctcctgctcaagaattaattgcaagggatttgcatggtaatgaatggaaattcagacatatcttccggggccagcccaaaaggcatctacttacaaccggatggagtgtctttgtgagtgctaaaagacttgttgctggtgattctgtgctgtttatctggaatgaaaagaaccaactgcttcttggcattcgccgcgctaatcgaccacaaactgtgatgccttcttcagtgttgtcaagtgatagtatgcacttggggcttcttgctgcagcagctcatgcagctgcaacaaatagtcgtttcaccattttctataacccacgtgctagcccttcagaatttgtcatacccttggcgaagtatgttaaagctgtgtatcatactcgagtttcagttggcatgcggttcaggatgctgtttgaaacagaggagtcaagtgtgcggcgatacatgggtacaataactggcattggtgacctggatcctgtccggtggccaaactcacattggcgctcagtcaaggttggctgggatgaatccactgctggagagaggcaacctagagtgtctctatgggaaattgagccgttaactacatttcctatgtatccatcttcattcccccttaggcttaaacgaccatggcctccaggactgccttcattccatgcaggcatgaaggatgatgattttggcctgaattcacctctgttgtggctccgagacaccgatagggggcttcagtctcttaattttcaggggattggggttaatccttggatgcagccaagatttgatcccaccgtgttgaatatgcaaacagatatgtatcaagctgctgctgctgctgctgttcaggacatgaggagtttagatccttccaaacagctttctgcttccttacttcaatttcagcaaccacagaacttcccaaacaggactgctgctttaatgcaggcccagatgttgcagaagtcgcaacctcagcagatttttggaaataatcaagagaatcagcattcaccacaatctcagccacagactcaggctcatcttcagcaacatctacaacatcaacactcattcaatagtcagcatcatcatcaccagcagcaacaacagcaacagcaagtagttgataatcagcagatttctagtgcagtctctacaatgtctcagttgttttcagctcctcaacctcaatcaccacctatgcaagctatctcttccctgtgccaaaatttttccaattcaaatgggaactctgtgactactattgtttcccccctgcacagtatcttgggttcttttccccaggatgaaacatctcacctcctgaaccttcctagaacaagctcttggattcctattcaaaattcaagtgggtggccctcgaagcgtgttgcagtggatcctctcctttcttccggagcctcccattgtgttctacctcaggtggatcagctagggcaaccacatagtaccatgtctctaaatgctattacattaccaccttttcctggtagggagagctcaatagaccaagaagggagcaatgatccacaaaaccatctcttgtttggtgttaatatagacccctcgtcccttctcatgcctaatgggatgtcaagccttaagggggttagcggaaataataactcctcaaccttgccatatcaatcttctaattatctgaatactaccacaggcactgattcttcattgaatcatggaatgacacccaacataggcgactcgggtttcctgcattgtccggaagatgcaggacaaggaaacccactgaacaaaacctttgtgaaggtttataagtcagggtcctttggaaggtcattggatatcaccaaattcagcagctaccatgagctgcgtggtgaactcgctcgaatgtttggccttgaaggcgagttggaggaccctgtgagatcaggctggcagcttgtatttgtagaccgagagaatgatgttcttctccttggtgatggcccctggccggaattcgtaaatagtgtatggtgcataaagatactttctcctcaggaagtgcagcaaatgggcaacaatggccttgagctgttgaactcggttccaaatcaaaggctctctaatggcatctgtgatgactatgtgagccgtcaagacccaagaaatttaagcactgggataacaactgtggggtctttagactactaatagtctgtacttcttctatcatgtttaatattattacccttgcttctcaacccttagtgtacggttggaagcacctttgccaaaatgtagtttatatagcctactctttagcctttggattttgttttcctgctttttcctgctaggacaattcataaactaatactgtaactatatggcatctagtcattgtgccagctacaatatatacgatacttaatccgttaggaaatcaatgcgtgagatagcttctcttaacttgtacggaactttactttctagtttggttttggcttaaatgtttggggtgtatgatttgactcatagtatactaggcaatggagtggaggtgat

SEQ ID NO: 228 - DNA, 3889 bp, Glycine max
  misc_feature (1)..(3889): Glyma.09g057800.1
aaatagcaaaaggaggaatgtggaattagcgcttttctttttttcttttttatccattcgcagagaagaaaaaaaaaaaacaaaaaacgcacgcagcttttgtttcttttcttctctctcttttttagaatttaaatttaaggaagaaaaaaaaatcctgtttctcttcctcactgcactcttacgttacaccccgaaactcaaacccatcaacatctcgctctctctctctctgctatgaattagggttttgaaacagtgaatcttcaccacctcaggcgacaatgtgatatttgtaattttcattacaaaagaaggggacagctaatctttcagtagtatggcaactgagagtctgattagaatctcggaagctgggggtaaatggccttctcacaaggaagctgcagcttttggttcatcgtctcgtaacatggcgacggaggatttgggtatacttctgaagggccataggttccaaggtggtggaaaggatgcggcacccaatcgcagtggcagtgcacctcccagcattgaaggctcatttctggccatagaaaaccttttaccccagcataacaccgcccagaatgcaagctttgcaaatctaagcagcactacgcaaaattgcgagtctgaagaacaattgcgagctgatccagcttatttggcatattacaattccaatgtcaacctaaaccctagactttctcccccgcttacgtcctgggaaaatcgccatctaggacgacatattggcagttttagaaataattggagaatgtcttctgcagatgatagcggtaaaagttctgtacatttgactcaaaggactctttccacacacaaggaggagtctgaagatgattcagcccaacagccatatgacgatgaattagttaaggcaagtggaatatggcgtagacctgatgcaacttcattggcatctcagcacaaaaatatggttgatttaattcaggaagattttccacgcaccatgtcgcctgtatataataagtctctttctgtaagtcacggactagcggataaaccaattgatttagaagctggttctagctcttctcatggcccctctgttactacaatagaggctggtaaacatactgtaggtgcagatgacataagggtgtcatcaagtgttgatacccatgccccagttgcaagctcatcatctcttgaatccactggcagcattggtgttactgacttagacattgcaactgttgagtatcaactaaaggctcttggtgtatctaatgcaccaaattcagaaagtctgagttacaaagagaaatggaagaccggctaccagaacaatttgatgcaacgccagggattccagcaacaaaacaatccatatgatgttcctagtgccaactctcaaaatgtaaattctgtgtatgctggtagggaacaatttccttttaattccaacaagttctccaatgtccagccactactgcagtcatctggttttacacctcccctatatgccacagcagctgcttatatgtcctcagccaatccattttacactaatatgcaggcgtcaggtatatatactccacaatatgttggcggatacactgtaaatcccacagcttttcctccatatgttactgcttatcctcctcatggtgctgtacctcttgtcattgatggagctactagctccagttatactccactaacaccgggggtttcaattgggggaaacatttcgcacggagctgaaatggtacagacaaacaagtaccttgggcaatttggatttcctccgcagccttcttttggtgatcctatgtacatgcaatatcatcagcaaccttttgtggagggatatggtatttctggtcattttgatccactggcacctagagcaagtggtgttagccaaattagtccttatgattcgcaaaaaaggcccagtactggtgcttatttggatgataaaaaattacctgatcagagaactgctgctaatatgacctctagaagaggtggagtatcaattcctagttattttggacacatgccaaacatgggttttgtaatgcagcatccgagttcaccacttcctagtccagttttatctggatacccagaaggaagtccaggccttccaggagttaggaatgaaataaatctttccccggcttctggaagaaatggaggcataatatctggatggcaagttcagagatcttttgacagtgctcatgaccccaaaattgttaattttcttgaagacttaaaatctggcaaaagtcgaagatttgaactatctgatattattggacatattgttgaatttagctctgatcagcatgggagtcgatttatacagcagaagttggaaagttgtagtgtcgaagagaagacattagtgtttaaagaggttcttccacatgcttctaaattaatgactgatgtttttggtaactacgtaatacagaagttttttgagtatggaagcccagagcagaggagagaacttgcagatcgacttgttggccagatactgcctttaagtttgcagatgtatggctgtcgtgtaatccaaaaggcacttgaggttattgagcttgaacagaaagctcagcttgttcatgagctagatggaaatgtaatgagatgtgttcgtgatcaaaatggtaaccatgttattcaaaagtgcattgaatctattccaaccaaaaagattagctttatactatctgcatttcgtggtcaagttgctactctatcgatgcatccttatggatgccgagtcatgcagagagttctagaacattgcacagacgagagtcaatgccagtttattgtagatgaaatcttggagtcagtctgtgctcttgctcaggatcagtatggtaattatgttacgcagcatgtcttggagagaggaaagcctcaagaaaggagtcaaattatcaacaagttgtcaggacatattgttcaattaagccagcataagtttgcttcaaatgttgtagaaaaatgtttggagtatggtgataccaccgaacgggagttgctagttgcagagatatttgggcatgatgaaaaatgtgataatttattgacaatgatgaaagatcaatttgcgaattatgtggtccagaaggtcattgatatctgttctgaaaatcaacgagcaatgttgctttctcacgtaagaattcatgctcatgctttgaagaaatacacttatggaaaacacattgtggctcggttggaacatcaatttggagagaatcaaacacccagctcatgatgaaaatagagagacgaagccatgggtctccagcaatgctgctgtgacgtgcaaaccccgcagcatcaacatatgttctgttgatcacagaaaatagctgagacatcgatagcttccagttgtttttactcctgacttcatacctgcaccgtgatagtttccacattgatggcttcaggggttatactttgaaactcaatgtaattatgtcattcaaataattgtttgaaaaagttatttgaataattatttggaaggaaacccttcccttcctgatgtataatttactgggtcttccgtgcttagtgtgtggttttcttggagatacaagtattcaagaattcttaaactcaactagtccttggcaacttagaacctggtccttgtcatgcatgttttaattgggaatgattacattgaatgttggttataactctaattgtgggatatacttatctgatagcagatattggtattgcattacaagtttagcggaccacaggaaagataggttttggttcgattagttttatagaagagtgaaactgaatggcatttgtattttaaataaagcagaagtaaaacaaaaaa

SEQ ID NO: 229 - DNA, 2713 bp, Glycine max
  misc_feature (1)..(2713): Glyma.14g084400.1
gcgaagctggccgtgacgtggatcctgagcccgtggcgcatcaatcaccgttttgatgttcatcaccctcgtcacgggagtgaaaagggtatgcttggaaaagaaattcaatttataaaaatgttgacagatgtcattttttaattgagtcggaccctttctttcggaggctcaagcatcattttccttttcctttgccctagaagttcatttttcatgcgcggttcagttgaggaacataaaagcagaggaagttcattccaatttccaattgccgctcaagcattttggagcttcaaaatcaaatggggtttgcccaaacattcgattttctgggtaaagtctcggtctttcgcttcctctgactgtgtacttgttgctgtggccaggttaagagttctagaattctattacttacttactcttcacattcctaaactgagtttatttgacactttggagtatatagatttcttgagtttgtttatgttcacatcatgtctaacaataccaactcctcctcctcaaaaactcaacccactttcttgaatcctcctaatcctaacccccaacatttctcgaaaagcaatggtgtgggcaatcaccaaggccaaaacttgatgcccccttttatgcagccacccatgaatgcagcacctttcatgaatgctgcaaatcacaatcattttcccttgcatatgcctcatatgggtttgcctggtcatcaacagggtcaaccacatgtggggggtttaggtccccaaaacagtgttggcaatgccaattacaacaatccaatgtttcctcctgttcagggacaagtcatgcagaatcaagctcaattcaatttgtctccactccagggacaatttttagcacaaagtattctcaacatgcttcagcagcccaacatgaatatgagtatgccaaatggccagttttgtggcccttaccttatgcagaatatgaatccgcagttacctatgcaaatgccaaacccttctcagggggttccgtatggtatgcatcctggttcctgccccatgttcgggtttccaaaccaagtgcctcaggctatggtccctcagaattcaatgttttccacaaatccccagttaggttttgtgcccggaaatcaggtccggccacagattgacccaaacgagaaaaaccttaatccaccaaacgttagtgcaaattcttttgtatcatcatcccctttttcgtctcagcagttacaagggaatacttctggatcacttaatcctaatttggctcacacaaataactctcaacctcctgcatttatgaaacaggaaaaacctaatagcaatattaaaactaatgttccaaactctaattggaaaggatcacctagcaaaaacttcaaaaataaaccaaatcgaggggggtttcaagcaggattccagaagtcgaaatttcatgatgtcaacaatggaaagaagggaagtgggtttcctatagaacataatggcaaagggcctaacagtgggaggggaggacactatggtttaaaaccaaaggaacataagcagcaaccagaaagatccttgtctgtgacttacactgtgcaagagatccaacagtggcgtgaagcacggaaaaagaatcatcctttcaataacaacattcagaagaagcacagtgaacacccaaaagacaggaaggccattaatagggaggtcttacaaagagagctcaaggaggtgttagcgaagcaagctgaattgggagttgaagttgctgaaataccatcatactacttgaagaattctgacaatcaagctcttcagagtgaagggaaaaacaaatttactgacaaaagaaaattccaaaacaagttcaacaagaaatcagacagaaaaggtaggttcgccaagaggcagaagtttgatgacaaagatttttcagaaagcccctctttgaagaagaggaagcctacattattgcagaaactcctgagttcagatgtaaagagggataagagccacctgattcaggttttcaggttcatggtaatgaattctttcttcaaacattgtcttgataagccgctgagatatccgttggtcgtggttaaagaaaaggggtctgaagttgatggtgaagaaaaatacttgcacaccggaaaagatgttcttaaaggagggaatgaggaaacagttcaaaaaattgtgaccttcaataatgataatagccatgattgtgaagatgaagatagtgatgatgacgagaatgattctattgttgataataatcttcataaagatccttcttccttggttaaaagacagtgtgatagtggcgaaggaattgggaaatttgatgaagaggagggagaaattatagaatgaaattccaaggttgctctctctatttttgcagcaaagttttttaatactgtgatggtaacattttctgttaaatcaatttttgtttctatcgttgttttactagtatacatatgatgttacagtaaatatttttttcagcgaagcttttgaatactaatagttatacttgggcagggcacgtcttagattagggacagtttaattataatattaatagatgttttgacgctgtgacatgcctcaatgttatattaggatttctctcagaacttgtatttgccacttattaaagaagcaacaaccatgccgatgggtttttcctatttgcgcatttgaat

SEQ ID NO: 230 - DNA, 1952 bp, Glycine max
  misc_feature (1)..(1952): Glyma.07g256500.1
ttttgagttgaattgaaaatcgagaaacggaatgatgaaataacgtagggagttggatctgtggtttggttgcgatgcggtgtgttgcgaatcactgtccaatcccgatcgcttgatccagacagtgaatcagaatcagaatcagaatcagaatcagagagaaacgatgagggcagtaagtgcgttaatggtggctcggatgttgacgcgggaccactcgctccctgtccttggcaacgaaagcatacccttcggatcggtgtggtggttcgcctatgccggcgtctcctgtttcctcgtcctcttcgctggcatcatgtccggtctcaccctcggactcatgtctctgggcctcgtggacctcgagatcctcgaacgcagtggttctcctgccgagaaaatgcaagctgcgattatacttcctgtggttaaaaaacaacaccagcttcttgtcaccctacttctctgtaatgctgttgccatggaggctctgccgttatacctagataaactattcaatcagtttgttgctatcattctctctgtaactttcgttctgtttttcggggaggttattccacaagcaatttgtagtagatatggtcttgctgtaggtgccaactttgcatggctagtgcggattttaatgattatctgttacccagtttcttatccagttggaaaggttctggatcacctattggggcataatgaggctttatttaggcgagctcagttaaaagcccttgtctccattcacggccaggaggccgggaaaggtggtgagcttacacatgatgaaacaacaattatcagtggagcactcgatttgactgaaaagactgctgaggaggctatgactcctattgaatcgacattttctttggatgttaattcaaagttggattgggaagcaatgggaaaagttcttgctcgcgggcacagccgagttcctgtctattctggaaatccaaggaatattattgggcttctactggtcaaaagtcttcttactgtacgaccagaaacagagacacctgtcagtgctgtatccatccggagaattccacgggttccatcagatatgcctctctatgatatactaaatgagttccaaaagggaagtagtcatatggctgctgttgttaaggctaggggaaaaggcaaagaaactccacaaatcattgatgaagagaaaaatgaagaaaacaaaagcattggtggggattcacagttgaccactccgttgctacagaagcaggatgcaaaatcaggaagtgttgttgttgacatagtcaagccttcaaagccttccagcattaataagctgtctgttttgcaacgtagtgatagcacaacaaatggtccctcttcagaaaatattgaagatggtgaagtgattggtattatcactttagaagatgtatttgaagaacttctgcaagaagaaattgttgatgagacagatgaatatgtggatgttcataagagaatacgtgttgctgcagctgcagctgcttcctcagtggcccgagctccatcatcgcgaaggttgactagccagaagggagcaggaatccaaagtaagccagggcaagctccaaagaaatctgcagaggaaaatggattgaactctacaaagcaataaggaaatgcatattagcctgtcgggataatgaacctttaatactgaggggctgtttatgtgtcagcaatatgatgaaaaagaagtcaaggagagttttttagtcatttgatctttatgatgtatcaaattaataactttccttttaggaagggcataaacggatgtattcctatttatataggttattaagccggtgccatgctgcaattttatgttagatccaaaatgtcttttgtttttaccgaaagaaaagtgtgtttgttagtttcttttacccatttctctcaataatctattatttaca

SEQ ID NO: 231 - DNA, 3437 bp, Glycine max
  misc_feature (1)..(3437): Glyma.15g193400.1
acaattctcctactcccgtttcccattcaaagacgcatctctgtctccctctctcttacggtctttactcttttaccattctcattttatcgactacgtacgtaatcaaacacacaataatataaagcgctggatctgaattttccgttgcatattctctgtttctccctgtccaataaatttgtgatttggatctgagaagagatggatcgagaaaatggcgacggcgacattgaaggcggtggagccgacgacgggggttttcgatcttcgattggtcgcaagtaccgccctgtgttggccaacgatcgcgcggtgctcgaaatgtcctccattgatcagggatcttcttcttccgcttccgcatttccagatcaaaatcctaatctcagaaaagtaaatacgagtgtgaatgggagttcggatgctaaagaagagaacctttctcatgaacagaaacctaatggatcccggcagcaggaatctaaactggaattgttcggttttgattctcttgtcaacattcttggtctgaaaagtatgactggtgagcatgttacacaaccatctagtcctagagatggtgaggatatttccatcacagctggcttgcctaagcctgctgctcccaaactgggtacgctgatgggtgtctttattccatgtatacaaagcattttgggcatcatctactacattcgtttctcttggattgttggtatggctggcataggagagacattgttgcttgtttctttatgtggcacttgtacattccttacttcaatatcattgagtgctattgcaaccaatggtgccatgaagggtgggggaccttactatctcataggccgtgcccttggtcctgaagttggagttagcattggtctatgctttttcctgggaaatgctgttgccggagcactttatgtattgggagctgtagaaacatttttgaaagcagttccttctgctgggatttttagagagactgtcactcaagttaatggtactgcaatagcacaacctatagagagtccaagttcacatgacttgcaaatatatgggattgttttgactattctgttatgctttattgtatttggaggagtgaagatgataaatcgggttgcacctgcttttctcatacctgttttattctcagtcgtctgcatatttttgggaatttttttggcagggaaggatcatccttcagagggaattactgggttgagttcagagacatttaaagaaaattggagtgcagattatcaaaagactaacgatgctggaattccagaaactgatggctcggtaacctggaatttcaattcattggttggcctctttttccctgctgtgacgggaataatggcaggttctaatcgatcatcctctctgagagatactcagcaatcaattcctgttggaactttagctgcaactcttacaactacttctctgtatcttgtttctttgatgttatttggtgccgttgccaccagagagaagcttttaactgacaggctacttacagctacaattgcctggccttttccttcattaattaaaattggaattattctttcaactatgggtgctgctcttcagagcctgactggtgccccacgtctgcttgcagcaatagccaatgatgatattttacctattttgaactactttaaagttggagatggcggtgaaccacatgttgctaccttttttactgctttcttatgtattgggtgtgtcgttattgggaatctggatcttatcactccaactgtaactatgttttttcttctatgttacactggtgtcaacttatcctgcttccttctcgatcttctagatgcccctagttggcgtcctcggtggaaatttcaccattggagtctgtcccttgtgggagcattactttgcatagtgatcatgttcctaatctcttggtcattcaccgtggtgtctttgctccttgcaagcctcatatataagtacgtgagcattaaaggaaaggctggggactggggagatggtttcaaaagtgcatatttccaactagcacttcgtagccttcggtccctaggagcaagccaagtgcacccgaagaattggtatccaattccactggtattttgccgaccctggggcaaactgccagaaaatgttccctgtcatcccaaacttgcagattttgctaactgtatgaagaagaaaggtcggggaatgtccatatttgtctctatactagatggggattaccatgaatgtgctgaagatgccaagactgcttgcaaacaacttagcacctacatcgattacaaaaattgtgaaggtgtggctgagattgttgttgcccctaacatgtctgaaggcttccgtggcattattcagacaatgggccttggcaatctcaagccgaacattgtggtgatgcgttacccagaaatttggcggagggaaaacttgatagaaatccctgccacctttgttgggataattaatgattgcattgttgcaaacaaggctgtggttattgttaagggtcttgatgaatggccaaatgagtaccagaggcagtatggcacaattgatttgtattggattgtgagagatggtggtctcatgctgcttctctctcagctccttcttaccaaggagagctttgagaattgcaagattcaggtcttttgtattgcagaagaggatgcagacgcagaggggctgaaagctgatgtgaaaaaattcctttacgatcttcggatgcaagcagaagtctttgtcataacgatgaaatgggatgcacagatggatggtggtgggtctcctgcacaagatgagtcaatggatgcatttactagtgctcagcaaagaattgatgattacttaacccaaatgaaggcgacggcgaagagagaaggtactcctctaatggcagatggcaagcccgtggttgtgaacgagaagcaggtcgagaagtttctttacacgacacttaagctcaattcgacaattttgagatattcaagaatggctgctgttgtgttggtgagtctacctccacctccagtgagccacccagcatatttctatatggagtacatggatctgttgctggagaaaataccaaggattttgattgtaagaggatatcgtagagacgttgtaaccctattcacatagtttttaagtggagtctaggacactaatcacatttctccctcactgtttatatttttgtagcttaagtgcaagtggctcattctttttgtaccaattttcttgctcaagagggtcttttgtatccaccagattttataggaaaacatgaaattattttcaatttataatttcgttgtaattaatttcgtatcagaagataaataatgttattcatacttccacagcagacatctcaattcacccgacggttgcct

SEQ ID NO: 232 - DNA, 1759 bp, Glycine max
  misc_feature (1)..(1759): Glyma.20g126800.1
ccaaatgtgtcgatgcgaaaatatctcgttcatgttaatgttatgataacgaggaatggactatgatgctgttctgttggtgacggtgtgattgattgtgacgaaatctgacaatgaagcgtggagcattgttgtcagtgcttgcctgcgccttcgcggcggtgatctgggcagcgaacggcgacgacaacctcgtcccgcctcgccgggaagtgtacggcaatgggcgaatattcgacatcagtcatcggtaccaacccgagatgccggaatgggaatcgaatgacggcatagggcagttcctgtggcttcccaagagcatgaagaacggttccctcgccaacaactccgaaatgaagtttcccacccacaccggcacgcacgtcgatgcccccggtcacgtgttcgaccactacttccacgccggcttcgatgtcgacacgctcgacttggacatcctcaacggacctgctatgttggttgatgttccaagagatagtaatattaccgctcaagttatgaagtcgttgaatattccaaggggtgtaatacgtgttctcttccgaactttaaataccgaccggcggctgatgtttcagaaggaatgggactcaagctatgtgggattcacagccgatggagccaaatggctagtggagaacacagatatcaaacttgtaggaattgattacctatctgttgcttcttatgattacttgattccatctcaccttgtttttctaaaagacagggagatcattctcgtggaaggcttgaagcttgatgatgttccagcagggttatattcagtccattgcttacctcttaggttggctggtgctgagggatcaccaatacggtgcattctgattaaaaattagggtatgtgtggataacttggatttacattttttggttctcttttgtctggaacctatgaagcacgaacactccagtcccttgtcatgtctggtatctgacaccgacacgatactcatactacattctatattttgaacattacaggtgtccacatgtctgtgttcggtgtccgcgtcggtgtcggtgcttcataggctggaactgataaattggcatgggggtgtggtgtccttatggagcaagatagtttcaatgttgtgcaacaacttttgtagcttatgtttacacttactaaaaacatgcataagcacttcaaaaaatcattttgaaaaggaaaataatgtatatatagataatttgcacatttcattagcacttcaagagagatgcaacgatattggcattgcgctgaatttggttttcttttgtctgctaggttggaaaggaataagttggcacaatggtgtctttatggagcaagatagtatcaataatgtttgttaactttagtggcttacgtgcacgcttataaccatatgcacaagcacatcaatttaataggtcgttttgaaaaagggaagatcatgtatatagataatttgcaaatagcagttagatcatattttaattacttagaaaaaagcattaacagttctacccaacaaccgcatgttttggtctcagtttgttattgacaatggccgcttagggctcaattctagttgacagcaaaggctactgtacattgacgacgaacacacaatctgtgtacagtaggatatctactcgattgagcaaatgttgctgtaattggtgcatggccacattatgtttactatgatacctattgttgcaagattccgctacttcggctacc

SEQ ID NO: 233 - DNA, 3504 bp, Glycine max
  misc_feature (1)..(3504): Glyma.05g031900.1
aggctccaaggctttctcaccgggcgccaaaaacccctttcgtcgctttatcaacaaacctcactctctcatttcaaacgcagtgcccaaaccagaacaccgaaattgaaaaagctgcagatacaaatcccaaagtgccagattgagctttgctttcgtcttcttgtatcagtgctgcgattcgtttcgatttgaggagcatggaccttcagaacactgtcaaagaagccctaaatgcactgtaccatcaccccgatgatgcggtgcgcatgcaagccgatcgctatctccaggatttccagcgaactttggacgcgtggcaggtgggtgataatttacttcatgatcccagtagcaatctagaaactttgatattttgttctcagaccttgagaagcaaggtacaaagggactttgaggagctcccttccacagcttttcggccgttgcgtgactcattgaataccttactgaaaaagttccacaagggtcctccaaaagtcagaacacagattagcattgcagtggctgccttggctgtgcacgtgcctgcagaagactggggggatggtggtatagttaaatggcttagggatgagatggattcccatccggaatatataccgggattcttggagttacttacagttctacctgaggaagtattaaattataagatagcagctcgcccagaaaggcgacgtcaatttgaaaaagagcttacatctcaaatggaagtttctcttaatatcttgacagcgtgtttgagtatttctgaacttaaggagcaggttcttgaggcatttgcttcatggcttcgcctaaagcatgggattcctggatcagttcttagttctcatccgctagttctcacggcattgtcaagcttgaattctgagttactttcagaggcatctgtaaatgtgatttccgagttaatacactacacaacagcaggggacattgatgtttctgcaaatatgcccttaattcaagtcattgtacctcatgttatgaatctaaaagcccagcttagtgattctacgaaggacgaggaagatgtgaaggcaattgctaggttatttgcagacatgggtgattcatatgtggaactgattgcaactggttcagatgaatcaatgttaatagtgcatgcactgttggaagttgcttcacatgccgaatatgatattgcttctatgacttttaacttttggcatagtctccagttaaacttgactaaaagggagtcctatatttcatatggcaacgaaacatgcattgaagctgagagaaatagaaggctgcatgtttttcgacctgcatatgagtcacttgtatcgctggttatctttcgggttcagtatcctgaagattatcaagacctttcatatgaggatcttaaggaatttaagcagactaaatatgctgttgcggatgtattaacagatgcatcatcagttcttggcggtgatgccacacttaaaattctatacatgaaactgcttgaggctgtatctggccatggtaataatgaacacaaggaatggcgtccagcagaggctgctttgttttgtattcgggcaatatcaaattatgtgtcggttgtcgaagcagaagtaatgcctcagatcatggctttgcttccgaaacttcctcatcaaccccaactacttcagacagtgtgtttaactattggagcttattcaaaatggcttgattctgcatcttgtggactgtctgtactgccatcagttttagatatcctaatgaatggcatgggtacatctgaagaatgtgcagctgctgctgctttggcatttagacacatctgtgatgactgccggaaaaagctttgtggatgcttagaaggtctattccacatctacaacaagacagttaatggagaagatagttttaaagttcctgccgaagactctttgcatctggttgaagcgttgagtatggttgttactgaacttcctccagatgatgctaagagagctcttgaggcattatgcataccagtcataactcctttacaggaagctatcaatcaaggtccagaaagcttgagtaaaagaccttctcggcagttaacggttcatattgatcgatttgcctacatctttagatttgtaaatcatcctcaagttgtggcagatgctattcaacggctatggccaatttttaaggctatttttgatattcgtgcttgggacatgagaacaatggaatctctctgccgagcatgtaaatatgctgtgagaacttctggaaggttcatggggctcacaattggtgccatgctggaagagattcagagtctttataggcagcaccaccaaccatgctttctttatctctccagtgaagttataaagatatttggttctgatccatcttgtgctgactacctgaaaaatttgattgaggcactcttccagcacacaacactccttctcacaaatattcaggaattcacagcccggcctgatatagcagatgattgttttttgttggcctcaaggtgtattcgctactgtcctcaactgtttattccctcgtctgtttttccttcattagtggattgctctatgattgggatcacagtacagcatagggaggcttcgaattccatattgcatttcttggctgacatttttgatcttgcgaattcttctgtgggggagcaatttataccaataagagatagtgtaataattcctcgaggtgccagcatcaccagaattttggttgcttcattaacgggagcacttcctaaatctcgagtggatgtggtatcttatacactcctggcattaactcgatcatatgggatgcaagcgctggaatgggcaaaaaagagtgttttgttaattccatcaacagctgttacagatgtagagcgatcaagattcttaaaagcactttctgatgcagcatccggaggggatactaatggacttactgttcctgttgaagagctgtcagatgtttgccgacgtaacagggccgttcaggaaatagttcaggaagctttgagaccgcttgagttgaatatggtgaatgtatcatagaggattggtaaatgccattgatagagagggccattttgtttagggtcctgtctgttagttaggctagttggttgtgtattatctatctgttatattcatttttttttatccattatcattctccaattttttagaagaatttgcccctgcatgctctgatgtgttggccggaagaaattcgatgggggtattgtatctttttattcttgagatgtgggattggtgagtgatgtttgtcccggttgtcatttttggggggcggaggttacatggtatacagttgtaatttaatggaaacagaaaaggtgggggaaaatagagtacattgataagttgctgcaaattttcaagtttggaatgaatatcgattttggaatctgtgactgaattgtgttcagttcgtcggaccaatctgttaaaatga

SEQ ID NO: 234 - DNA, 4958 bp, Glycine max
  misc_feature (1)..(4958): Glyma.19g016300.1
tcaaacaaacaactaaggaagcctcccacgtttgcaacaacataaaacgcgcacacttcttcacaaatcatcattttcatattttttgccttgcgaatcgaatgttttataatttttctctcctttcttctaactccaaaatttgagttttgagacttgcacgtaccaccgcttctcctccctttttccacccgaaattctctctctcttttttttttttttctctgtccaaatctcgtttcattttctactgttgtttgcgtctcaatttcctcgtttttctttacttaccaacgtaagagagggacacagacacacacaacaaaccaacctcgaatttccctgtcttatcaaaccccttccttcactcttctttcatttctcttgtttctcggagatctactcaatttgtctcccagcaaattttcctaggaaaaaagttctgggaaactcctaagaaatgaagagggcgagggatgatatgtatcctgcctctcaattcaaacgcccctttgcttcgtcacgtgctgattcctatggacaaaaccaagtccctggaagtggaggaggagggggaggcggcggcggagggggaagtggcaatggaggtggtgttggcgggggagcaaatgcttcccagaagctgactaccaatgatgctttatcctatttgaaggaagtcaaagacatgtttcaggaccaaagagagaagtacgacatgtttcttgaggtcatgaaagatttcaaggcccaacggactgacactgctggtgtcataaaaagggtgaaggagttattcaaggggcacaacaatttgatttttggatttaatactttcctaccaaagggttatgagataacgcttgacgaggatgaggctcctccaaagaaaactgttgaatttgaagaagcaatcagctttgtgaacaagataaagaaacgattcctaagtgatgagcatgtttacaaatcattcttggacattttaaatatgtaccgcaaagagcataaggacattggtgaggtttatagtgaggttgctaccctttttaaggaccatcgagatttgctcgaggagttcactagattcttaccagatacttctgctgcaccttccacacagcatgctccatatattcgaaattcattgcagcgctttaatgagcggggttctatggcccctatgatccgccaaatgccagcagacaaggcacaacgctatcgacgagacaggcttccttctcatgatcgtgatatgagtgctgaacgccctgagctggatgatgacaagacaatgatgaacatacacaaggagcagaggaagcgtgaaagtagggagaggagaatgcgtgatcaagatgagagagaacatgatcttgataacaacagggatttgaacttgcaacgctttcctgacaaaaaaaaatctgtcaagaaagctgaaggttttggaatggcttctgactttgcttcttatgaagacaaagataccttaaatagcccaggcatgtatagtcaagcattcagtttctgtgagaaagttaaggggaagttgagcagttcagatgattaccaaacattcttgaagtgccttcatattttcagcaatggaataattaaaaggaatgatttgcaaaatttggtaactgatttacttggaaagcattcggatcttatggatgaattcaatgatttcttggagcgttgtgaaaatattgatggattccttgctggtgtcatgagtaaaaagtcactgtctactgatgctcatttatcaagatcatcaaagttggaggaaaaagacaaagagcacaagcgtgatttggatggagctaaagagaaggaaagatacagggagaaatacatgggaaaatccattcaagaacttgaccttagtgactgtaaacgttgtactcccagctaccggcttctgcctgcagattatccaattcctacagctagtcagagatctgagcttggtgctcaagtcttgaatgaccattgggtatctgtgacttctggaagtgaggattactctttcaaacatatgcgcagaaatcagtatgaagaaagcttgttcagatgtgaagatgacagatatgagctggacatgttattggagtctgtgagctcagctgctaaaaaagcagaggaattgtataatagcatcaatgaaaataaaatcagtgtggagactctgaaccgtattgaagatcactttactgttctaaatttaaggtgtattgaacgtctatatggtgatcatggtctggacgttatagacatcttgcgtaaaaacccaacccatgccctgcctgtaatattgactcgactgaagcagaagcaagaggagtggagtaagtgtcgttcagatttcaataaagtatgggctgagatttatgctaaaaatcactacaaatcacttgatcatcgtagcttctacttcaaacagcaagattcaaagaacttgagcaccaaatctttggttactgagattaaagaaattaaagaaaagcagcagaaagaggacgatattattcagtctattgcagctggaaataaacagcctctaattccacatctggaatttgaatattctgatgttgggattcatgaagacctgtataaacttgttcgttattcatgtgaagagttattctctagtaaagagttgttaaataaaattatgaggctctggagtaccttcttggagcctatgcttggtgttccttcccaatctcatgggacagaaagggctgaggacagaaaaactggacataatgttcgcaattttggtgcaccaaatgtagggggtgatggaagtccccgggaagatactctttcgataaattcaagggtaccaaaatctgataagaatgaagctgatggtagagtaactgaagtgaagaatgttcactggactactgtggcggcatccaatgataaagaaaatgggtctgttggtggtgaaattgttagtagagatgatccattaatggataaaggacagaaaaatgtagaatgcaatgataaagcctctggatttagcaaacaatttgcctctggtgaagaaggagctaaaaacaatgtatcaattgcaattagaggagaaaacagcctgaacagaactaacttagatgcgtcttcaggctgtgctcttactccatcgcaacctactgatgttgatgactctgtatccaagtctcagggtgttaatgtaccttcggtggagggatgcgacatggcaactccagtaccagtggtcaatggtgttctaagtgagagcagtaaagttaaaactcatgatgaatcagctgggccctgcaaaattgaaaaggaagagggtgaattatcaccaattggtgactctgaggaggataactatgttgcttatggagattcaaatgtgcagtcaatggctaagtcaaagcacaacgttgaaaaaaggaaatatcagtctagaaatggagaggatgaatcttgtcccgaggctggaggtgacaatgatgcagatgctgatgatgaggacagtgaaaatgtttctgaagctggtgaagatgtctcaggcagtgaatctgctggtgatgaatgcttccgtgaagatcatgaagaggaggaagatatagaacatgacgatgttgatggtaaggctgagagtgaaggtgaagctgaggggatttgtgatgcacaggtcggaggagatggcacatctttgccattgtcagagaggttcctttcatccgtgaaacccctcacaaagcatgtatcagcagtttcatttgttgaagaaatgaaggattcaagggtgttctatggaaatgatgacttctatgtgctttttagacttcatcaagctctttatgagaggatcttatcagcaaaaacacattcaatgagtgcagaaatgaaatggaaagcaaaagatgctagttcaccagatccttattcaagatttatgaatgcattgtacaacttgcttgatggatctgccgaaaatgccaagtttgaagatgaatgccgagcaattattgggaaccagtcgtatgtgttattcacattggacaagttaatatacaaattggtcagacagcttcaaactgttgcaaccgatgaggtagacaataagcttctccaattatatgaatatgaaaagtctcggaagtctgggaagttaaatgattctgtatatcatgcaaatgctcatgtcatccttcatgaggataatatatatcgtttacaatgttcctctaccccctcgcgactattcatccagctcatggacaatatgaatgaaaagcctgagttgtttgctgtttctattgatccaaatttctctttttatctgcacagtgattttctgtctgtctttcctaacaaaaaggagccccatggcatcatactgcatagaaacaaacgccaatatggaaacttagatgagctttctgcaatatgctctgccatggaaggtgttaaagtagttaacggattggaatgtaagatagcttgcagctcatccaagatttcatatgttcttgacacacaagattttttcttccgaccaagaaagaaacgacggacgccatcagggaccacaacctcccagtctcgtagggacagagaggaaagattccgcaaattgttggcacactcgcaatttgtatcttcatgaatagctgttctctaacatcttctaaaacagctgagactcaaatacataatgtgagtcttggtgtagcaacctaggaaccctttgggtttacaattttatttgttgtcatagtacttgaattttcacatgaaagtggaggaagggaatatagagatgggagtgtgtaatgcgtttatgaggtctcatgcgttttgcacactcctttgtaaatagtttgcttcaatatatttgtagaaatattgtttaccaaattgtttattagttgcaacacagttgcttcctccgttcc

SEQ ID NO: 235 - DNA, 917 bp, Glycine max
  misc_feature (1)..(917): Glyma.11g055200.1
gaagagaataattgaaagcacgggagcagcggaacacaggaataatggccacgcgtagattgaggcattgatgacacacagctgtaaaccagctttggcgcatgtgagcctctgtcctctgtcccctgcccccaacacccaacaacaaataaaactcatactcactctctctactctattcccatggcttctcttctcaccctcgctctgttactcttctgcattgcctttacctcccacgttgccgtgcaggcgcacatggaggacacggccttcaacctcatgtcggacgccttggagtggcccaccacaatgtcgctctacgacgaagacgacgcccaagaggatgtcgagaacgcttacagtcggagatcgttgttctggcggcggatgaagtactacatctcctacggtgctctttctgctaaccgaattccttgcccgcctcgttctggtagatcttactacacccacaactgctacagggcacgaggccccgttcacccttactccagaggatgctctgccatcacgcgctgccggagatgagtttgatgtgagttccgatctgatcacacgcttcagatcggagatggaaataaaaaaaccgagtaccgtttatggtggttttgttttgttttgttttattggtgtactagatttatattgtggatttaaggcgtcgttagttgtgctaagcaagtcaagtcaagtgaaagtgtcgtgtttgagttaacggtttttggggattcttcacttgcatcgactcgttgcgctgcgcaaatgaatctgcttgctttttgtgttacttcgtcatttattcgtttgtataaacccaacggtttctttttcttggtgttcagagcactttcagtttctggttttatcttctatttaattttaaaaatattgttgta

SEQ ID NO: 236 - DNA, 1639 bp, Glycine max
  misc_feature (1)..(1639): Glyma.08g191200.1 a2.v1
tcacttaaaaaaaaagaacaaacgtcccaagtatcgtttttccatatttgattacagcctcaactcaaccgtgtctgaagtcacttcaatggcggatagggaaccaaagcctaaagactcgccttcagaaaaagatgtgaaaagtccaaacatttttgagcgagctaaggaggagattgaggcagtgtttcatcatgacaaatcgcctcaccatcacaaagaaactcatgggacaagtgatgacattgacgagggaacttcacctgatgaaataaaagcgcctggtgtgtttgaacgggtgaaggaggagattgaagctgttgctgaggccattcatcccaagaaagaatctgaatccgacactcgtgatgtgtcaccaaagtgatggctaggatgtgcctttattttgtaacaaagagtgtgaagacttgtttcaatggtgttaaccatcaaaactaccttggctttgtccactgatctttctttcttttttttattttgttgttgttgttgtttcctttaagtagtaaatttctcttcttttttcaattgattatgtgaatgcttagtccttttgtcttcaaaaaaagaaagattatccctgaactggtacattatcaatgtgaatgttttattgtagactctgttctgtaacttcatctggtgcatcaacaacatttataattcactaagtatattcagtctttttcttttggctgctaaatttatgccagcagcacatttatctgcacatgttacctctaaatgaaataaaatttgggattcaattacactgatattggtgatttaaattttttacattcaattcacatggaagtttaacttgggtataagggatttggggaagtttaacttgactttactcgggaagtgatgctggaatttgttcaatcatcatggggagctgtgggcacaagttctggaatcaaagtatggggggtggaggaatttagatgcgacaaaaagatccatcagagaatctctttggtggcgggatcttggctctatttgtaatctatccgaggaggggagctagctaaaaaatgggacaaaatggaaagtaggatgtggatcaaaggtcttgttctgggaagatggatgaatggaggatggggtctcgcttaaggagaagtatccaagactataccagatttctcaacaacaacaccaacacatccaacaaatggggacaatagcaaatacaggttggaaatggaagcttcagtggaggaggttctttttggaggctgaaatagacactgttgcaaaatttatggaagacttacagcgtctgatggtacatgtgcatcaataggacatgtggagatgggagggagattcaagcggtaagtatacaatggggagtgcttacgaattactcaataggaatttgccattggagagtcaagatgaaacgtttaaagtattatggaagataaaagtctcaagtaaagcaacagtttttgcttggagattgatcaggaaaagattgcctacaaagaataacttaagaaggaggaatgtggaaattaatgatgtcacttgcccattttgcagaagtcatgatgaggacgaggctcacttattcttcacttgtgctaacatgttgccgctatgg

SEQ ID NO: 237 - DNA, 2058 bp, Glycine max
  misc_feature (1)..(2058): Glyma.17g011500.1
tgtccctgcaaattgcactttataatataataatcgctttttattttctgtttatgtcaggcgaattcaattttttttcttttgcttcccttgtttcggtggataacaaaaaaaaaataaaatctattatcgaggtctctttttcaaattgcacggatgcgtcgattttttttcgataaaaaaaaatccatatcggagaacatggggaacaagatgaatgcgatcgcgttgtgcttgttagtgtcgaccctgttggtttctgcggtgtattgtgcaccgaatgctgggctccgtaggattgggctgaagaagattaaattggaccctaaaaacaggcttgctgctcgagttgggtccaaggatgttgattctttccgggcttctattagaaagtttcatctccaaaacaactttggtggcactgaggaaaccgatattgtcgcgttaaagaattacttggatgcacagtactacggtgaaatagctattggaacttctcctcaaaagttcgctgtcattttcgacactggcagctctaatttgtgggttccatcatctaaatgcaccttctcggttgcatgctactttcatgctaagtataagtctagcaaatcaagtactttcaagaaaaatgggactgctgcggcaattcaatatggtaccggagcaatttctggtttctttagctacgacagtgtcagagttggtgaaatagttgtaaagaaccaggaatttattgaagcaactagggagcctggtgttacatttttggcggccaagtttgatggtatactgggacttggatttcaagagatatcagttggaaatgctgctccagtgtggtacaacatggttgaccaaggtcttcttaaggaaccagtattttcattttggttcaaccgcaatccagaggaagaggaagggggtgagattgttttcggtggtgttgatcctgctcactataagggaaagcacacttatgtgcctgtgaccagaaaaggatattggcagtttgatatgggagatgtacttattggcggtaaacccactggatattgtgctaatggctgttcagccattgcagactcagggacttctttgttggcaggtccaacgactgtcataactatgataaaccatgcaattggagcatctggagttatgagccaagaatgcaagaccattgttgcagagtatggacaaacaatattggatttgcttttggctgaaacacaaccgaagaagatctgttcccgaattggattgtgcgcatttgatgggactcatggtgttgatgtggggatcaagagcgttgtagatgagaatgaaagaaaatcattgggtggtcatcatggtgctgcttgtcctgcatgtgagatggcggttgtttggatgcagaaccagctgagccgaaatcagacacaagatcagatactaagttacatcaaccagctttgcgataaaatgcctagcccgatgggagaatcagctgttgactgtgggaatatctcttcattacctgtagtgtcctttactattggtggaagaactttcgaccttagcccagaggagtacgtactcaaggtgggtgaaggtcctgtggctcagtgtattagtggctttactgctatagatattccacctccacgtggccctctctggatccttggtgatgtcttcatggggcgttatcacacagtgtttgattttggtaaactcagagtgggatttgctgatgctgcatagagtgttagcgtttctcagactatggcgatccaattgctattattagtttatataaccgttgcagtcaaaatggacctaaagttctggcttgtacaggtttatattattaatgttaatactttgggtgttccataatactaaaagcttaacagatgtatctgcggctgcgaaatagtccataattggctccgtagactctatgcatgttttagttgaaagggtatagctatggttctcatgattccttgttagttccctctgttcgtcttcttttgcaagatgcgtgtatggggttatatgcgatgaccttcc

SEQ ID NO: 238 - DNA, 2512 bp, Glycine max
  misc_feature (1)..(2512): Glyma.20g140100.1
attccaaagtaggcgtcacaaacaggaattaaagaatgagcaaatttcaaagttgacagacactggtcagagtttaacccagatataaactccaacagctcaacattccaaccacggcatggcaaatatcctctgctttcagagattaacaacacttcaacagacgcgtaaaccctgccatggcttggaattcctctttcaagcttatctttctctttgtccttgttaacttcctcagttttgcaacacctaaggcacaacaggtccctacttttcttgcccaggattgcccaagcaacggaaccacagccaacagcaccttccaaataaacatcaggaccctcttctcttcactatcttccaacgccaccgccaacaatgtattctacaactccacggtggcgggagcaaacccctctgacactgtctatggacttttcatgtgcaggggtgacgtcccatttcagctgtgtggacagtgcgttataaacgcaacccagaaactatcatcagacttacagtgctccttgtccaaacaagctgtgatctggtatgacgagtgcatggttcgctattccaaccgctcctttttctccaccgtagacacaaggcctgctattggcctgttgaacagcgctaatatctcaaaccaggcaaacttcatgcgtttgatgttcgacaccatgaacgaaacagcagatgaagcagctattggtgccaagaaatacgccacgaagcaagcaaacatatctgggtttcagaccctctattgtctggttcagtgcacgccggacttgtcaacccagggttgcagaagttgtcttagtgatgccatagggctccttccatggtgttgtgaaggaaaacaaggagggagaattctaaatcccagctgtaatgttaggtatgatttgtaccctttctaccgcaccaacgtctctgcaccaccagcgtctgtccctccaaccgattcttctaattcgggaggaggaggtagtgaaatttcaccggggacaattgttgcaattgtggttccaattacagtggctgtgctgctatttattgttggaatttggctcttaagtaaaagagcagcaaagaagcgtaactctgcgcaagaccccaaaactgagactgagatcagtgccgtggaatccttgagatttgatttcagtacaattgaagcagccacagataaattctctgatgctaacaagctaggcgaaggtggatttggtgaggtttacaagggcttgcttcctagcggccaagaagtagctgtcaagagactctctaaaaactctggacaaggtggaacagaatttaagaatgaagtagaggttgttgcaaagcttcaacacaaaaatttggtgaggcttctaggattttgcttggaaggagaagaaaagatacttgtttacgaatttgtagccaacaaaagccttgactatattctttttgatcctgagaagcaaaaatcattggattggacaaggcgatacaaaattgttgaaggaattgctcgaggcattcaatatcttcatgaagattccaggcttaagattatacatcgtgaccttaaagctagcaatgtcttgttagatggagatatgaatccaaaaatctcggattttggcatggcaagaatatttggagtggatcaaactcaagcaaataccaacaggattgtagggacatatggttacatgtctccagagtatgcaatgcatggagaatactctgctaagtctgatgtatacagttttggggtcctcattttggagattataagtggcaagaggaacagctctttctatgaaacagatgttgctgaggatctgttgagctatgcctggaaactttggaaggatgaagctcctttggagttgatggaccaatcattaagagaatcatatactcgaaatgaagttatcagatgcatccatatcggtttactgtgtgtccaagaagatccaatagatagacctacaatggcatcagtagttcttatgcttgatagttactctgttactctacaggtacctaatcagcccgcattctatataaacagtagaactgaaccaaacatgccgaaggggcttaaaattgatcagtctactaccaattcaacatcaaagtctgtcaatgatatgtcggttagtgaagtagatcctcgataagtctgaaattgtgaggaggttttagagaagatatgtatccatctacattctaaatttttgttagccgtggcttcttatgaccgaattacaattgctgataacattttatgattgtttatttttcaacgaggaaaagatatctgcgggtcgtttaggacattttttttgtatttattgcgtgtggcacgagagtcaacttcagttaattattaagttggcaacatatcaacttctaagatgtacgtacttgtcatttgttcattagcttgatcgtagaacaggcttctattttaaaataaaaccttaaattctaaggagtttgcattttttta

SEQ ID NO: 239 - DNA, 840 bp, Glycine max
  misc_feature (1)..(840): Glyma.15g009500.1
ctggtgcacttcctctctttctgcttccttcctttatcctctctctctatctctctctcaaaagcttttatttgtttccgtcgtacgttgtatgcttgggagcacaacacaatgaaagaaaacgtaggaaaccctctgcacctaaagtctgtgaaccatatctctctcatctgtacctccgtgaaagaatctatcaacttctaccagaaccttctcggattttttcccatcaggaggccgggatcatttgattttgacggggcatggctattcggatacggaattggaattcacttgctgcaagccgaggaccccgacaacgttccaagaaagacgaaaattaatccaaaagataaccatatatcattccagtgtgaaagcatgggggcagtggagaagaagcttggggagatggagattgaatacgtgcatgcaacggtagaggaaggagggattaaagtggatcagttgttttttcatgacccagatgggttcatgattgagatatgcaattgtgatagccttcccgtgatccccttagcagcgagtggcaataacaatggcatggtcagatcatgctccagactcaaccttcaaattcttcaacagatacaccaatttctcaaccaatagctagccactagtcagatcatgatgatgatcatttcctcctttttcatgctgtttagattattccttattttatcattctgtctagttcctttgcagtaataaattattccatatatattcgcttcttattaaaataaaaaaaagagaagtatggtttaatttgtgccagtggtttttccgaaatgagatttgctttcttgcatcatt

SEQ ID NO: 240 - DNA, 1899 bp, Glycine max
  misc_feature (1)..(1899): Glyma.08g222300.1
caggggtagtgtcggtgatgaagtaaggaaacagtttctctcaccagtcaccactacaataaatatagttacaacatcaacttgggttttttgtcttagtgtcccacacctccatgtgctgctcaagcttcttctgtttcacttctacttgaagtttataactgctcctcaattctaatctcgccttccccatttatatatcttctactttctagagtaagagtagctacactcatacacaccacacaacacagatcatgggagtggatttaaggcaagtggtggcgggtgtgctcaccctcacaatgttcgtcatgcttattcacatgatcaaaagggaccattttgatgctgttcatgataaacttcctggaacagaggatgtcggctttgaaagtacaaactttgatactactcatgttagaaagaacatcgggatttggaagggagatgctgatgagttaaacccatgttgggctaagccatctgaagacaatgcggagactgaggggtttgttaccttttcactaaccaatggcccagagtaccatatatctcagatagcagatgcagtgcttgttgctcgcagtcttggggcgacacttgtcatccctgacattagaggaagccaacctggtgacaagaggaactttgaggacatttatgatgccaatgtgttcatgaaaagcatggaaggagtggtcagagtggtaaaggatcttccttctcatgtaacaacacataaaattgctgcggtcaaggttcccaatcgggttacagaagaatacatagctcaacatgttgaacctatttatagatcaaaggggagtgtaaggcttgctacttattttccttcaataaacatgaaaaaagcaggggaaaaaagtgatgctgattctgttgcatgcttagcaatgtatggaagcttagagttgcagcaagaaacgcacgaccttgttgactcaatggttgaaagacttaagactttaagccgaaagtcagatgggcaatttatagctgtggatttgagggttgagatgttgaataagaagggttgccaaggaagtgatagtgaaaaagagaagagctgctttaatgcacaagaggttgcagtgtttttgaggaagattggttttgaaaaggatactacaatctatgtgacacaatcaaggtgggatgaaagcctagattctcttaaagatttgttccctaaaacatatacaaaggaatccatcattcccgcagataaaaagaaaaagttcctagactctgaagattctgagttggagaaagtgattgacttttatattagttctgagagtgatgttttcgtaccagcaatatcaggtctattttatgcaaatgtagctggtaagagaattggctctggtaaatcccagatactggttccggctaatattccagattcatctgcttctgcctccagtttcttgtcccattatgtctccaagaaaaaccactttgcctattcttgttactgttagttcgaagtgaagacattcgtagcatccagtagcaaatgttgtgtactaattgtcctgaatgatgatgctttccaaaatgtaccctttcgggaatttcagttatggcctaaggcttcttgtttgactgttcaccaaaaaaattgaagttactgtcatttgacatgtacacagggctttctgaacggatatttagtttgtaaaattatggttgcccccatatttatttttcataactggtgaaacaattgataggccatttattgggttgtcttagatagaacattgttttaggggagggtattgatgtttcaaaaagcaaataaacatgcgcaatgtaccaaaacaaaaaaagagaaacaagagtttttttttgtccaatagcccctaaataatc

SEQ ID NO: 241 - DNA, 1807 bp, Glycine max
  misc_feature (1)..(1807): Glyma.05g075400.1
tttaccatcgattcattccctctaaatccaacggctgcaagagtcagtgcttcaccagcattgcagggtccaccccatcatagaaggtggaaatgcaggtacagtcaactgttacatacactcccaggaacgggaataaaaacgaagaagagcgagtcactgttccgtgttcccactgagtcggtatcaacgagtgaccgagtcgaaaagcgagtcaccactccccgcgctgcatggaccctctcgaagctttggtcgcccaaatccaagggctatcgagctctcccggcgacctcactcgcctccacactgttctaaagcaagccgatgactcgcttcgatccgagtcaactcgcctcgctccgattctcacacagctcgacccctccattcactccctcgggtttctctacatcctagaagcttccatgaccggtccggttaccaaaacgcaggctgaggtcgtcgttccgatcgttactaggtttatcggcgcttgcagcacggagcagattcgtttggcgcctgataaatttttatctgtctgtaagaggttgaaggatcaagtgatgctgttggaagctccaatacggggcgtggctcccttgttcaatgctcttcggaaacttcaggcctccgcagaacacttgactccgctacactcagagtttcttcttctgtgcttgttagcaaagtgctacaaaactggtctatccatattggatgatgatgtttttgaagtagaccaaccgcgagacctttttctctactgttattatggaggtatgatatgcattggacagaagcgctttcagaaggcattggaccttctgcataatgttgtaactgctcccatgtctaccataaatgctatagctgttgaagcttacaaaaagtatatattggtttctctcattcgtcatggacagttctctaccagtcttcctaagtattcttcttcaactgctcaaaggaacctaaagaacttttgtcagccttatgtcgaattggcaaatagttatggcactggcaaaattgcagaactagaggcatatgtcaaggcaaacgcagaaaagtttgaatctgacaacaaccttggactggttaagcaggttgtatcatccatgtataagcggaacattcagagattgacccagacatacttgaccctttctctccaagatatagccaacacagtgcagttaaatagccccaaagaagctgaaatgcatgtgctacaaatgattcaggatggcgagatatacgcaactatcaaccagaaggacggaatggttagattcttggaggatcctgaacagtataaaacctgtgaaatgattgaacatattgattcatcaattcaaagaataatggctctctcaaggaaacttactgcaacggatgaacaaatttcatgtgatcagttgtatttgtctaaggctggaagagagagacaaagatatgactttgatgatttcgatgttccacaaaagttcaacgtttaaggggctatgaatgatggaagtaaatctggttagggtccattacccgattcctttatcttttgttatccctggttctgagagggggagtattttatttcactcccaaatggaagagtgcttgttctgtcgtgaactagctcagagaatgttgaattgtctctactttattaactacataaaatctatagcacattctttgcacatgtaatcatgtatgctctattgaccaagcataatgcagtaatgttgaggtctcaaggaaaatatcctctgttctcgttatacgttgaaacgtcggagtt

SEQ ID NO: 242 - DNA, 2310 bp, Glycine max
  misc_feature (1)..(2310): >Glyma.08g140400.1
  misc_feature (1)..(2310): Glyma.08g140400.1
aaatatttattattaattttataaaataaaaaatgtcatatgtattaaaaaaaatctaacatttgacttttttttaaaaatatttattttttctttaaaattattttagagtcctcccatccatatataaagtgataggaattgaatgaatggataaagttcagatagagtactctagtttctgttccactttcccacctaacgttggattcatctaaaggttgaacccagaataaacctttctctctcgtttatgacaaaatgcagaatgaatattcattctcatcttgctttgcaggttgatgaagaagtgggtggatgaggccgagtaactcttgatgatgcgcaaggcaagctgtagtgtggaccaagtcattcaagtttgggagtgattgcggaaatatcggtgtacctgtgtctgacccatacattgcaattattgtactcgtcatgataaaacaccaccaccagagtacttagataatataacccctttctcacaaacaccacttttggaagcaaagacagacactagctattcgaatttgagttctcccaaataactaggatgatttggatagcactttttttagtttcactggcttttctgcggttatggagaagcaataagaatgcaaagaaattaccacctggtccaaaagggttgccaattttgggaagccttcacaagttgggaccaaatcctcatcgtgacctgcacaaactagcccaaaaatatggacctgtcatgcacttacgtttaggttttgtgccgaccatagttgtttcttcacccaaatctgctgaattgttcctcaagacccatgaccttgtctttgctagtagaccacgtttcgtggcggatcaatacatctcttgggggcagaggaacttaggctttgctgaatatggttcttattggcgcaacatgcgcaagatgtgcacattggaattgctaagccaatccaaaattaactccttcagacgcatgagggaagaggagcttgaccttttgatcaagcttgtaagagaggcagccaatgatggagctgctgttgatctcagtgtcaaggttgcaacactcattgcagacatgtcttgtagaatgattttaggaaagaagtacatggaccaggacatgtgtgggagagggttcaaggctgtgattcaagaagcaatgcgtttattagcaactcctaacgtaggagattacattccttacattggtgcaattgaccttcaaggcctaacgaagcgcttcaaggtactttacgaaatcttcgatgacttcttcgagaaagttattgatgagcacatggaatcagagaagggagaagacaagaccaaggattttgtggatgtcatgttgggctttttaggtactgaagaatctgaataccgcattgaacggtccaatatcaaagctatattgctggatatgttggctggttcaatggatacttcagctacagcaattgagtggacactttcagagctactaaaaaatccaagggtgatgaagaaactccaaatggaattggaaactgtggtgggtatgaagaggaaggtgggggaatcggacctggacaagttgaagtatttggagatggttgtaaaggaaagcatgaggctccatccagtggtaccattgctaataccacaccaatccacggaagattgcatagtcggagattttttcatacccaaaaaatcaagggtcataataaatgcatgggcaattatgagagacccaagtgcatgggttgaggcagagaagttctggccagagagatttgaaggaagcaacatagatgtgagagggcgtgacttcgagctgataccatttgggtctggcagaagggcctgtccaggattgcaattgggcctaataacggttcgtcaaacagtggcccaacttgtgcattgctttgattggaagctgcccaataacatgtttccagatgatttggacatgacagaggcgttcggcctcacaatgcccagggccaatcatctgcatgccattcctacgtatcggctttccaattaaagggattattagggaaaggaaaattatgcatgtacaacatgtagacattcagataacgagttttaatggagtatttgtgtactttaagtgttgtccaaatataatttggtgaaacagtttcatggtatgtgtttaggttgatttcagtaagatttattagaaaataaattacctttttccttccttatctttaatgttgtgtttggttgaaatgatggggaaaaatggaaataaaagaaaaatattagaattagagtaaa

SEQ ID NO: 243 - DNA, 5051 bp, Glycine max
  misc_feature (1)..(5051): Glyma.U034000.1
atccagtggcgagttccaacctgacccttgcgtttctcgcgaaacatgagctttgttcactagttcgtaatcataatgccacgaaacaaatatgtgaaacaatcatttcatattattcactccaaacatttaaattaatcaattactaatattttattaaacagagatactcgttttttttacactcaaaaccctacgcaccgccgcatacggggcgccgccgcacacggggcgccgccgcactttgcacttggctctgctctggtcaacaggaagcacgataaggttgggttttcgaggaccaggataatcgttttggttcgtgaaaaaaaccctaaaccctttcctacgctcttctcaggaagaaaaagaagaagagatgaatagggcgagaactgaaggcataactttcacgaaggagccgttcatggaggatacagggcctcgcaagataaagaacatgaagttctccacgttatcagaatcggaaataagcaaaatcgctgaagttcaagtgtggaaaggttcctactatgactcctttaagaagcctatccacggtggcttgttggatcctcgcatgggccctgctaataagagtcttgtctgtgcaacatgcgatgggaactttcatgattgtccagggcactatggatacttaaaccttgcccttcctgttttcaatgttggatatttaagtaccattgtggaaatactgaagtgcatttgtaagggctgtgctcgtattctccttgatgaagatacccgtaaaaaacatctgaagaaaatgagaagttccaaaaagagtgagctggataagattgattttgtgaaagttcgtgtaattaaagattgtagcaaagttgtgaattgcccaagatgcggatatatcaatggttcagtaaagaagcttccggcttcgctgacaatcatacatgattgctcaaaatgtagaaattatattgttgaagagcttgattccgcactttctcgtatgaaagactctagggcgaccaccaatgtgtctaatcgaattcttaatcctttccaagttctttccctgtttaaaagaatgcttgatgaggactgtgaattactttatgttgctgaaagaccagagaaactcataatgacaaacgttgttgtgccacctatagctattcgaccttcagttgttatggatgaatcactgagcaacgaaaatgacataacagagaggctaaagaacataatccaagcaaatgctgttttgcgccaggaattacaagaatcaactttttcgtccaaatttctggatggttgggatatccttcaaaatgaagttgctcagtttataaatagtgatgtccgtggtataccattctatatgcaaccgaccaagcaattggctggttttgttcagcgcttgaaagggaagcatggacgtttccgcggcaacttatctggtaaacgtgttgaatatactggcaggacagttatttcacccgatcctaatctgaagatttcagaggttgcaatacccatccatatggctcgtatattgacttatcctgagcgtgttactcaccacaacatagaaaagttgagacaatgtgtgagaaatggtcccgataagtatcctggtgcgagaatgcttagacgtgatggaggtcactcatggtccttaaaagttctttgtaggaagcgtgctgcagatgaattgaggattggtgatattgttgatcgccatttggaagatggagacattgttcttttcaatagacagccaagcttgcatcggatgtctataatgtgtcacagggcaaggattatgccttggagaactttaagattcaatgaatctgtatgtaacccatataatgctgactttgatggtgatgagatgaacttacatgtcccacagactgaggaggctaggacagaggctattttgttgatgggggtggaaaacaatttgtgcactccaaaaaatggcgagattctggttgcttctactcaagactttttaacatcttcctttctcataaccaggaaagatactttttacgaccgttctaccttttcacttatttgctcgtacataggtgatggcatggatcctattgatctgccaactcccgcaattgttaagccagttgaactttggagtggtaagcagttatttagcattatactgcgcccacatgctaatatgagagtctatgtgaatcttactgttaaggagagaaactacactgaagacaagaaaataaaagacaagaaaatagaatggaaaacattgtgcccaaatgatgggtttgtttattttcgtaatagcgagttgatctctggacaagttggaaaggttactttaggaaatggcaacaaagatggactgttctctgtgctactgagagactatagagcacatgctgctgcatcttgcatgaatcgtttagctaaattgagtgcacgatggattggcaatcatgggttctcaataggcattgatgatgtccaaccaaaagagattctgattaacaagaaagatgaaacaatttcagaaggttatagggaatgtgataaacacatagaagctttcaataagggaaaactagaactcttagctggttgtgatgctgcgcagacattagagactcggattactggggtattaaatggacttcgtgatacggcagggaaggtctgcatgcaaaccctacactggagaaatagtccattgatcatgtcacaatgtggctccaaaggatcttctattaatatcagtcaaatggttgcctgtgttggtcaacaatcagtcggtggtcgtcgtactcctaatgggttcatagatcggagccttcctcatttccccagaaaatcaaaaacccctgctgcaaaaggttttgttgctaattccttttacagtggattgtcagctactgagtttttcttccatacaatgggagggcgagaagggcttgttgatacagcggttaaaactgcagacacgggatatatgtctcgtcaattaatgaaatccctagaggatttgtttttacattatgattatactgtaagaaatgctggtggctctattgttcaattttgctatggagatgatggcatggatccagcaggcatggaaggaaaaaatggaaaaccattgaattttgagcggttgtttcttaaaagcaaggccatatgtcccaatgatgaagatgatgaaattttatcttcctcagatgtgagtaaagtagttcatgagaagctctcagaatttgatatgtctaggttagcagagaaaggggtttttgaggtgggcttctctgctgacttcgttgaatctctacaatcctttatcaaagataatgcaaaattaacggaagaaggtttcactgatgagcattctcaaaacctgaaaaaatttgggcagaggatatctgggatcactcgtaaacagctagatgtttttttgaatatttgtctatctcgttatcattccaaaaaaatggaggctggagctcctgttggtgcaactggagctcatagtattggagagcctgggacccagatgactttgaaaactttccactttgctggagttgcaagcatgaatgttactcttggagttcctcgtgtcaaagaaataatgaatggaaacaaaaaaatcagtacaccaattatcactgctatacttgagagggatgacaatgcaaatactgcaagaattgtaaaaggtcgaatagaaaaaacaaatttaggccaggttgcaaagagtataaaagttgttatgacttcaagatcagcatcagttgttatcacccttgacatgaaaagaatccaggatgcacatctaaatatagatgctaatattgtaaaagaatcaattttacgaactaaaaagacaaaactgaaaccagagcatatcaagattttagatattaaaaagcttgaagtggttccccaagatgtggatagaagtaaaatccattttcagcttcactatctgaaaaatttgcttccgacagttgtagtgaagggcattaaaactgtggatcgagttgttatcagtaaagacaccaaggctgaaaagttcagattactggtggaaggcacgggttttcgagaggttatgggagttgaagggattgatggacgtaaaactgttagtaatcatatccacgaagtgagggacacactgggaattgaagctgctagagagagtattgttaaggagataaagtatacaatggtggatacacatggaatgaatatagacatacgccatatgatgcttctagcagatatgatgactgccacgggtcatatccttggaataaatagatttggaatttcaaagatgggcaaaagtgtattaatgcttgcatcattcgagaggacagcagatattcttttccaggcatctgtacgtgggagggatgactcgattggtggagtaagtgaatccataatcatgggtataccaattcaaataggtactggaatgatcaaggtcaaacaaaggttggatcctccggagttgcctcatggtaccagtcctattctatcttgaatttgaaatatatatttccagcaagaatgtggatcatccaggtcggagtgcattgaatgctgtcagcttaagttgggaaatttgaaatgtatgtgcgtatattttgccaaaaactattgcagaacatttctctgcttagagatgcatgcatggaatgagatttcctggcttccaaatggtctttagctatcaccagagttcaagcacatgagaaggggataggaaagaaaaggagacattattttcaaccgagcattgcttgtatcttttagccaaaatatgattttaatgattagtaatcattgtgaaattttgcattttacaaatctcttattgacatcgatccatgtagtttatctcatagtaggataactatttgttgcatcaccttaaccattataataacaatatcaaataactaattttaaattagctaaccttagtttgtaataataacaataacagatatttaattttatacaattttacattaact

SEQ ID NO: 244 - DNA, 940 bp, Glycine max
  misc_feature (1)..(940): Glyma.10g195900.1
gcactttgtctctctctttccgttcccttgatgtaatggctttatgccgattcgcttactcttattctcctgcttctgcttccaccatttttcgtttcccgaaatacccttcgaaacacactaaattctccttgctaccactctcattctcaacgatggaagctcctccagaaggttatcgtaggaacgttggtatctgtctcatgaacaatcacaaaaagattttcgcggcttcgaggctcgacattcccaatgcttggcaaatgcctcagggtggtattgatgaaggtgaggatccaagaaatgcagctatcagggagttacgagaagagacaggagttaattcagtagaagtgatcgctgaggtaccatattggttaacttatgacttcccaccaaaagtgagggagaaattaaatattcagtggggatctgattggaagggtcaggcgcagaaatggtttctttttaagttcactgggcaagatcaagaaattaatcttttgggtgatggtactgagaaagctgagtttggggaatggtcatggatatcacctgaacaagtaattgagcttgcagtggatttcaagaaacctgtctacaaggaagtcttagcagtgtttgctccacatttccaataaatcttatctttggctgaaattgttactgatgccttgggtgattatgagggctgctttaaaaagaatgtattccaattaactaacgagaccattattctcttttttctcctcttggccataataacccatagggcgggagaagagggctgtttattttgtctgaatgaaatatgtattgtcatgaaaattgttgtgcaatgtattgcatttgcatctgtccgctgtttttgtcatgatgaagtattgttttttcttattcataggaattgaatatgatatcagaagttttataaaactca

SEQ ID NO: 245 - DNA, 989 bp, Glycine max
  misc_feature (1)..(989): Glyma.16g078500.1
ctttcctcaacaacgccgcgtgcagtcccaaccctaggcagagagaaaattccccaaatcacaaaccctagattgagagaaaccctaacacgccatgggaacacccgagacatctcgcgaaccctgccccgatcgcatcctcgacgacataggcggcgccttcggcatgggagcggtgggtggctccgccttccattttctcaagggtctctacaattcccccaagggcgatcgattcgtcggcgccacccaggccgtgcgccttaacgccccccgcgtcggcggcagcttcgccgtctggggcggcctcttctccgcctttgactgcaccatggtctacgctcgccagaaggaggacccctggaactccatcgtcgccggcgccgccactggcggcttcctctctatgcgccagggcctcggcgcctccgcccgctccgcggcattcggcggcgtcctcctcgccctcatcgagggcgccgggatcatgctcaacaagttcctcagcgcgcagcagcccatgcctatgatcatggacgagccgcagccgcagcctccgcagtcgtccgagcagccgtggctcggagggtggttcggtggagggaacagagaggagaccgccggcagcggcggaagcgagacgaagattctggagagtttcgatgctccccctgtgcccaattttgagtataagtaagtggagagattatcctgtggttcagagttcagaccaaattcctaattgatctccacatgacatgaaattgagtgtcatagttaattgaaatgcttgactagtttcatgtagagattgattgattgagatcataaaacatgtggtggtctgagactatctaataatttctcaagtaattggggtttggttataggggttagttattttttgtggaagagttgagaagttaaatattgaatttgttgttgaacctcacttgatgattgtctatcatacaatgattttgttactt

SEQ ID NO: 246 - DNA, 2865 bp, Glycine max
  misc_feature (1)..(2865): Glyma.09g017000.1
ttaggagcaaaaaaagttgacgtttgcaaatagtgacacgccaaattaagttacacacagaaagactcgttcgtttccttctctcacttccccttttctcgtccattggttcacttcttttcattctctctctctctgagaagggtaagaagccattcaaggaaataaaaatcgcagtcttcaaagaacgggcacacaagaaagcgcgtttttttttcctctcaacgtaacggattttctccttcactgtttccaacatacccagagggaaaagagaaagtgggtcttcttttcttctcagaaagtttcattcttggcttcgaatctcttcattttcttgatctctgtccaaagggtctcgtgtagtgtagtgcctttttttttttttttcctctttttctcgctctagagaatggtggcagtgagaaacattgtgctgctgttgctttgcattactgttgtggctccgattgtgctctacactgatcgccttggcacctttgagtccccttcaaacaaacaggagtttattgaagatgtcactgcttttgctttcagtgcagcagactttagtcatttgaatctgttaccccaggaaacttcaacggctgtgaaagaacctgttagggttgtgtatactgaggaggattcaactaacaaaaggaatttgcctcaaggcttgcaattggtgaaatcaagggagcatgtgtttgccaggatgttgtcaactacaactgaggaagatctggctaaaaaggagaaccccattaaactggtgactgatggaattaagcaaggaaatcaaggtgatgcatctggtgaaaatgtaaatggggaagatgctattgatgttgatgacaatgatgggaaacttgctaaatcaattagtgcttctactcaagagcctgaaattaaggagcaacaactagccacagaaacttctagcaaaataaaccaaaaaggttctgaattgtctgaaaccaataagcagaatgatcgaacaccatctgatgcccgggtgaagcagataaaagatcagcttatccaagctaaggtctatctttcccttccagttgtaaaatccaacccacatctcactcgggagcttcgattacgggtaaaagaagtttcacgaacacttggggaagcaatcaaagattctgatttacctaggaatgcaaatgagagaatgagggcgatggagcagacactgatgaaaggaaagcaagctcaagatgattgtgctgctgttgtgaagaagcttagggctatgctccactcatcggaggagcagcttcatgttctcaagaagcagactttgttcttaacacaattgacagcaaaaacactgcccaaaggtcttcattgtcttccattgcgccttactactgagtatcataatatgaattcttctcaccaacaattcccccatcaagagaatttagaagacccccatttataccattatgccatattttcagacaacatattagcaacagctgttgttgtgaactcaactgtttccaatactaaggatgcctcaaaacatgttttccacattgtcactgatagactcaattacgcagcgatgaggatgtggtttttggtgaatccacctggcaaggcaaccattcaagttcaaaacattgaagactttacatggttgaatgcaagttacagtcctgttcttaaacagttgggttcccaatccatgattgattattacttcaaggctcatcgagtaacttctgattcaaatcttaagtttcggaatccaaagtatttgtctatcttgaaccacctccggttctatctgcctgagatctttccaaagctcaacaaagtgctgtttttggatgatgatattgttgtgcagaaggatctgactgatctgtggtcaattgatttgaaaggcaacgtaaatggtgctgtagaaacttgtggagaaagttttcaccgatttgatcgctatctcaacttctcaaatcctcttattgcgaagaattttgacccacatgcttgtgggtgggcatatggtatgaatgtctttgatttagcagaatggaagaggcaaaacatcacagaggtttaccacaactggcagaatctgaatcatgatagacaactatggaagttaggaacactgccaccaggtctcataacattctggaaacgcactttcccgctgaaccgatcttggcacattttaggtcttggctacaaccccaatgtcaaccaaagagatatcgagcagtctgctgttgtacactataatgggaacatgaaaccgtggcttgagataagtattcccaagttccgacgttactggacgaattatgttgattatgatcatgtgtatttgagagaatgcaacatcaatccatagataggtcgttttggtatgtttaatcattgaagttttcttagcatttgccagcaccttctaggtctgcgattccatctgtgtagggcttctacttttttaaagctttacaattctttttgtatacgtgttcctgtttttaaattggtattttttggtcttgcaacccttgatcagaaacctgcagagaatgctaactgtacttgtaaatgaaatgaagaggctagttctttttatttctttgtgattcttctttggctctatgttttagattgtaccctcccacctcccctgcccctttttcaaaacaactcgtcttgtagtcttccttttatttcttgtacatgtttttatttaagttgacactcttcaatagtgtatctagctttgtacaaccctgtgtagagtgctagctactcttttgctacatgtaataatacaataccttgtgcaatttattaattttaacccatcattaatcc

SEQ ID NO: 247 - DNA, 1678 bp, Glycine max
  misc_feature (1)..(1678): Glyma.19g006200.1
agcagcataacacttttctcttcaaataatttcattcttcagcttcttattactttgtatctctgtgtatatttgaaaatgaagaatatgaatatgaaactaaacaccattgcattgataattgccattgcattttctgtgtggtcttcaagctgcacagcagcacgtgtcagccactggaggaaactgaaagctgctgcatctgctacttcttttaatgtgttagactatggtgctaaaggtgatggacatgcagatgatacaaaggcctttgaagatgcatgggcagctgcttgtaaggtggagggttcaacaatggttgttccatctggttctgtatttttggtgaaaccaatctctttctcaggccctaattgtgagccaaacattgtttttcagttggatggcaaaatcattgcacctacaagctctgaagcttggggctctggtaccttgcaatggcttgaattctcaaaacttaatacaatcacaatcagaggcaaaggtgtcattgatggtcaaggctcggtttggtggaacaatgactctcccacttacaatcccacagaagtgatgctggaaagcaatggaagacttccaagcacaaaaccaacagcactcaggttctatggaagtgatggtgtaacagtgacaggcataacaattcagaatagtcaacaaacccatctcaagtttgactcttgcacaaatgttcaagtctctggcatcagtgtttcatcacctggtgatagccccaacactgatggaattcacttgcaaaactcccaaaacgtggtcatctatagtagcacacttgcttgcggcgatgattgcgtctctatacaaactggttgctcggacatatatgtacacaatgtgaattgtggacctggtcatggaatcagcattggaagtcttggcagagagaacactaaagcctgtgttagaaatgtcaccgtccgagatgttactatccaaaataccctcactggtgtcagaattaaaacatggcagggtggctctggttcggtccaaaatatcatgttctcgaacgttcaagtttctggggttcaaactccaatttccattgaccaatactattgtgacggtggaaggtgcaggaatgaatcatcagctgtggcagtttcaggcatacattatgtgaatgtaaagggaacatacactaaggagcctatctattttgcatgtagtgacaacttaccttgcagtggcataacccttgataccatacaactggaatcagcccaagaaactaaaaattccaatgttccattttgttgggaagcatatggggagttgaagaccacaacggtccctcctgttgaatgtcttcagagaggaaacccatcaaaagaaggaggaatcaattctaacattgattcttgctgaatttatcaacacaatgtccgggatatatagattattatgatatatacatcatggaaagttgttactagttagttattatgatatcttaaaattagttcacattcatgtaatataatgttggatttagtggattgtaataccgtgtgtcaaaaagatgttgggggagaagatttacaagcctatactacttagattgaaaaatgtatgaagtggaaagagtgtattagccatatgtaatatatcaattttttttttcaattatgtctgg

SEQ ID NO: 248 - DNA, 745 bp, Glycine max
  misc_feature (1)..(745): Glyma.03g147700.1
ctcacatcgagtccgagagaggttcctacagtagcaggaaatatcactcttcactctcgagctatattttgctttcttagttcccaacaatatggccaaatccactttctttgtctgccttaacctttcattactcttctctctagtcacagccacttactactcaagtttaaccccaacacttttgggttttcgcgaggagcagttcacccacctccacttcttcttccatgatgtcgtgacaggcccaaagcccagcatggtgtttatcgccgagcccaacgggaaagcgaaggatgcccttccgttcggaaccgttgtggcgatggacgaccctttaaccgtggggcccgaacaggactcgaaacttgtgggcaaggcccaaggaatttacacttcaatatcgcaagaagagatgggactaatgatggtgatgacgatggcattcaccgatggagatttcaacggcagcaccatcagcgtgttggggaggaacatgatcatgagtgaacctgttagggaaatggctattgttggcggcactggggcttttcgttttgcacgtggctacgctcaagccagattttactctgttgatttcaccaaaggagacgctatcgtggaatacgacgtattcgtgaaccattattgagatttactcttagtttttattggtttataataaaagaacaaaagatagaattattgtagaacaaaaagaatgagtaattaaccagtagtagtt

SEQ ID NO: 249 - DNA, 2625 bp, Glycine max
  misc_feature (1)..(2625): Glyma.20g233700.1
acacacacacacaaagttagcgtagaaacgactaaaatgtaatggtactaattagacgacagtcgtttattgaaaagggcaatttcgtgctagtgtggtagtgtggtacccttaccctgaggtgcaagacaaagtaacctaacggtgcttacaaatattaacagcggaagaagtgaagggcccagacggccaccgtctagggtagggttagggttttaattttcgccacacaacaacacacgctacctcactgcaaagcaatctcgctgcttccgttttcggatttcaatcgcttccactcgcagctcccatggcaaaagctacttccggaaccgtcaatcctcacagccgtaccggagttcgtatcgtcgtcgccggagaccagggcaccggaaaatctagcctcattataaccgccgccgccgataactttccggtgaatgtgctgccggtcttgcctcccacgcggttgcctgaagatctgtatccggatcgcgtgcctatcaccatcatcgacacttcttcccgtgctgaggatagcgataaagttgctgaagaattgcagcgggctgacacagttgtccttacttatgcatgtgatcggcctgagacacttgaaaatcttagtatattttggcttccacatcttcgcaaactagaggtgaaagttccagttatagtagttggttgtaagcttgatttgagagatgagaatcagcaggtgagcctagaacaggttatgtcaccaattatgcaacagttccgcgagattgaaacttgcattgagtgttcagcatctaggcatattcaggtccctgaagttttctactatgcacaaaaggctgttcttcatccaacagctccattatttgatcaagagtcacaaactctaaagcctcgatgcgtgcgagccttgaagcggatttttatcctttgtgatcatgacagagatggtgccctcagtgatgctgagctgaatgattttcaggttaaatgtttcaatgctcctttgcaaccatctgaaattgtgggtgtaaagaaggttgtacaagaaaaattgtctgaaggggtgaatgaacgtggacttactttgactggattcctatttcttcatgcccttttcatagaaaaagggcgtcttgagacaacatggactgtgctcaggaagtttggatataatgatgatatcaagcttgctgatgatctaattccacctataaaatgtgctcctgatcagagtgtggagctgacaaatgaagcagttgagtttttgagggcaatttttgatgcgtttgatggtgatggggatgggatgttgcgacctcgtgaacttgaagaattattttctactgccccggaaagtccttggactggaattccatatgaggatgctgcagaaaaaaatgcctttggaggactatcactagaagcatttttgtcagagtgggcacttatgacacttctaaacccaacttttagtgtggagaatctgatatacattggttatcctggtgattcatcatctgctattcgtgtgactaggaggcgacgtttggatcgtaagaagcagcattcagacagaaatgttttgcagtgctttgtttttgggcctaggaaggctggaaaatctgcattattgaattcttttattggaaggccatattctgaaagttacaatccaaccactgaagatcgttatgctgtaaatgtagttgatatttctatggaaaacagaaaatatctagtactgagagagattcctgaagatggagttaggaagctcctatccaataaggagtctttggcctcatgtgacattgcagtttttgttcatgacaggtctgatgaatcctcatggagaacatcgtccgaactcttggttgaaattgctagccatggagaagataccggctttgaggtgccttgcctgatagttgcagctaaagatgatctggattcatttccaatggctatacaagagtcaactagggttagtcaagatatgggagttgaggctcctatacctatcagtgtgaaattaggagatttcaacagtctgttccgtaaaattgtaacggctgctgagcatcctcatttaagcattccagaaactgaagctggaagaagccgcaagcagtaccacaggcttattaatcgatctcttatggctgtttcagttggagctgcagtggtcgtagttgggctggcagcttatagggtatatgctgcaaggaagaatgcgtctggttaaaagacaggttttgtcaatggatcaatgtccattagtttgatatgaatgcagcttgctcctggctagatatgtcaagttcaacattcagttggtttttttatgccatctgttgtagagtttgattttttttttttaatagaatcacagtatttaatttttctttgtcaaggttgaattgaattagcataatttttcccctcaaattaccgtttgtttcatctcgtttgtcaggggcttcgtggtataatatacacaataatgagatatactatcaggtccagttaattactggaatctttgaaagaatgatagcatgctctctgtattgaagattgcaataaaatgagaaaaagggatatatattgatgtagaaa

SEQ ID NO: 250 - DNA, 1859 bp, Glycine max
  misc_feature (1)..(1859): Glyma.10g124700.1
gactcaaaagctcaataaatgcaagtaaccaagtgaacaaatcaaatctctctctcaatctagccttctttctttttttcaatttccaaatcacgaaactcaagaagatggagaaagcgatcaacagacagaagattttgcttcatcatctcaacccttcatcatccacccaccccaacgaatcatcctccctccatgcttcagcatgtgtggcgggggatagcgctgcttatcaaaggacatcgacattcggggacgatgttgtgatcgtggctgcttatcggactgctcattgcaaagctaaacgaggtggtttcaaagacactcttcctgatgatctactggctcctgttttgaaggctgtaattgagaaaaccaatgtgaacccaagtgaagttggggatattgttgtaggtagtgtattggctcctggagctcaaagagctagtgaatgccgaatggctgcattttatgctggttttcccgaaactgtgcctgttaggaccgttaataggcaatgttcatctgggctccaggctgtcgctgatgtagctgctgctataagggctgggttctatgacattggtattggtgccggtttggaatctatgaccactaatccaatgggatgggatggatcagtgaatcctaaggtaaaaatgtttgaacaagcacaaaactgccttcttcctatgggaattacctctgaaaatgttgcacagcgctttggggtttcaaggaaggaacaagaccaggctgcagttgagtctcacaggcgagctgctgcagctactgctgctggtaaatttaaagatgaaattgtcccagttaccaccaagattgtggacccaaaaaccggtgaggagaaatctgtcaccatttctgttgatgatggaattcgacctggcacaacagtgtctgatctaggaagactcaaacctgtgttcaagaaagacggaagcaccactgctggtaattctagccaggtgaccgatggggcttcagctgttctgctgatgaaaagaagtgttgcattgcaaaaggggctacccattcttggtgtattcaggacttttgcagcagttggtgttgatcctgccatcatgggtgttggccctgctgctgcaattcctgttgctgttaaggctgcaggtctagagcttgatgatattgatctttttgaaataaatgaggcatttgcctcccagttcgtgtattgccgtaacaagctagggcttgatccagaaaagatcaatgttaatggaggtgcaatggcaattgggcatcctctgggttcaacaggtgctcgatgtgttgcaactctgttgcatgaaatgaagaaacgtggcagggactgtcgatttggagttatatctatgtgcataggtactggaatgggggcagctgctgtttttgagagtggtgattgtgctgatgagctatgcaatgcccggaaagtggatgaccttcttttatccaaggatgctcgcttgaaatagttacttcatactcactatatttggtcatcaaataagaaatcacaataaagtctttttctatggtagtgataatgtcaaccactcctcaagcgtttaatcctttctacttattagacttgcattaatttgtgatatattttggacaattgtaaacatacacttaatttttcttctatatctttttcactccactttttctttctatttctccctttctttctgatcacatcagtttttttggcttttttttcttcctcaagagtcactctctcttccctacatttatccactctaaaattggggtggacattcatgtatggtttggtcgtgtggaatggaaaggaagggaattgagaataa

SEQ ID NO: 251 - DNA, 1760 bp, Glycine max
  misc_feature (1)..(1760): Glyma.17g100600.1
aaataaatgagaaaaagaaaacagtaaaataagaagagtgatgtgatgtgaggatgtgacaggagagtgaagaagtattttgcgtttatttattcagcattcggcggagatttcaaacccaacttggcttgttccaattccattcattcgttcattcccaggttgtgatggcagcagcaccagcagctaccttcgctattggaaccaccggttccctcggccaaagaggaagctcgcttcctcaatcaaagtcctttgggttgaaattcaactctctgaatcatttgaagagcttctgtggcctcaaggccatgtcatccgtgagatgtgagtcggaatcctccttcttcggtaacaaaaccggtgctgctctacgggcgtcttttgcatccaaagctcaaaaggaaaacaaccacaactcgcagcctcaggcttcgtacaaagttgcggttcttggtgctgctggagggataggtcagccgctctcgcttctcatcaagatgtcgcctttagtttccaacctgcatctctatgatattgcgaatgtcaagggagttgctgctgatatcagtcactgcaacacaccctcacaggtcagggatttcactggagcttctgagttgccgaattgtttgaaggatgtgaatgttgttgtcatacccgccggtgttccaaggaagcctggcatgactcgtgacgaccttttcaacatcaatgctggcattgtcagggacttggtttctgctgttgcggattactgccctgatgcttttgttcaaattatcagtaaccctgtgaactctaccgtgcctattgccgcagaagttttgaaacagaagggtgtgtatgatcctaagaagctctttggggttaccacactggatgttgtgcgggcaaacacgtttgttgctcagaggaagaacctgaagctgattgacgttgatgtcccagttgttggtggccatgccgggattaccattcttcctctgttgtcaaagacaagaccctcggcgagtttcactgatgaagaaattgatgagttgactgtcaggattcaaaacgctggaactgaagttgttgaagcaaaggcaggcacagggtctgctaccttgtcgatggcatatgctgctgctagatttgttgaatcgtctcttcgcgcacttgatggagatggggatgtgtatgagtgctcatttgtggaatcaaacttgactgaccttccattctttgcttcaagggtgaaacttggtaggacaggagttgaggctttaattccatctgacctccaagggttgactgactatgagcagaaggctttggaagcacttaagcctgaactcaaggccagcatagagaaggggattgcttttgctcagaagcaaactgttgctgcttaaatttccttgtcagcaggtggtttcttgggttatggatttatttgagcataaatactacttagaggacttaggttgcagatttgttgtagcatctttactgcttccagaacttaggattcagactttctatgtatcaattctacttccagttttgttagtagaacgggaggacgcttccatttctgttctctaaaccgagcttaggttttggtcagaaatcttcaaagatgtaagcattataatgtagaattgaaaaaaaatgtaaacgttgctttttgaataatatggccattagaccaggttttggttttttgttgaatattttagtatttcagaaatctcctttactgatgcagaatttag

SEQ ID NO: 252 - DNA, 1687 bp, Glycine max
  misc_feature (1)..(1687): Glyma.14g121200.1
tcaaagttacgcggcgacgtgtagggaatccaaaggcgcagagtggaaggcagagaccaaaaaccactgacggaattgtagacgaaacagaacacagaaagagcgagcaacggccattcgatttcgatgtggcgcagtcgtgagtaacgtgcaataccacgggtaacgcggttttctggctcacctttccgcattttccttcttccctctcgcacccataagtacccctccctaaatcaacgctttcctcacaaaaaacaaaaactcacttctcatcattcattcatcttcgttctaagagccatgtctagcaccgttggccagaccatcaagtgcaaagctgcgattgcatgggaggctgggaagccgctggtgattgaagaagtggaggttgcgccaccgcaagccggtgaagtccgtttgaagatcctctacacctctctttgccacactgatgtttacttctgggatgcgaagggccagactccattgtttcctcgcatttttggccatgaagcttcggggattgtggagagcgtaggcgagggtgtgactcatctgaaaccaggtgaccatgccctccctgtgttcacaggagagtgtggagattgcgcccattgcaagtcagaggagagcaacatgtgtgagctactcaggatcaacaccgataggggtgtcatgatccatgatggccaatcaaggttctctaagaatggacaacccatacaccatttcttgggaacctctacattcagtgaatacactgttgtccatgctggatgtgttgcaaagatcaaccctgctgctccacttgacaaagtttgtgttctcagttgtggaatttgcacaggttttggtgctactgtaaatgtagcaaaaccaaaacctggttcctctgttgccatatttggacttggagctgttggccttgcggctgctgaaggtgcaagagtttcaggtgcttcaagaatcattggagttgatttagtttctgcccgatttgaagaagctaagaagtttggggttaatgagtttgtgaacccaaaggatcatgataaacctgtgcaacaggtaattgctgaaatgaccaatggaggtgtggatcgggctgttgaatgtactggcagcatccaagccatggtctcagcattcgaatgcgtccacgatggttggggtcttgctgtacttgttggtgtgcctagtaaagatgatgcattcaaaactgctcctattaatttcctgaacgagaggactcttaagggcaccttttatggcaactacaaaccacgcaccgatcttccatctgttgtcgagaagtacatgagtggggagctagaagtggacaaattcatcactcacacagttccattctcagagatcaacaaagcttttgatttaatgctgaagggacagtccattaggtgtatcatccgcatgcaagagtgagatggatatgaaaagtccatgactgtgttctgggacagactactcttatgtgatttatgaataaaaagagagaagagagaataaaaaatttattggtaaaatccccaattaggctattaggattatgattgtattgttgcacattgagtgttgggaatgacagggcatttagccctttgttacttgattgcggcttgtttcttgtcaatttgtcatttgatagtttccatgattttacttt

SEQ ID NO: 253 - DNA, 1261 bp, Glycine max
  misc_feature (1)..(1261): Glyma.18g142600.1
tcgtgttggcaactccactttcaaaatcccaccagcttcactttccatctttggcacccttaatgtcatattttgggtcccggcgtataatatgatcattgtgctaattgctagaatgttcaccaggcataaaaacaacttaacttagctccaaaaaatgggaattggcctcttcatatccatattttccatggtagcagcaacaatattggagctcataaggcttagaatggtgaggaggcatgactactatcaacttgaggagataccaatgataatattttggcagttcagaagagaagacaatcaagcagagatggaaacaacactcgtgcgctttctttactatttgtccacggcaatattgttttggtgctgtgccaacattgtgcacgctattgaattaccaaactacacagtgatactgcctgaagaatcagattttcagctcagactctacaatgaatcatcatggatctcagcccgagtttcaggaacttccttcgagcagtcctacaagcttggattttccaggttgtatcaatatattcacggtgccaattctaactcttcaaaaatcgcattcactgctccagtcctaacgagtgtcccctcgtcaccccccggggatggctacatcgtaagaatgttcgtatcgactcactttcaagggaagcccccgcaacccaatcctgaactgaagttgcgcatagagaagtggaaaactcagtgcattgcagttagaaagttcactgggtatgccaaggatgacaacatcaacaaagaaattgaagctcttgtaacaaccctaaacaagaactcggcaacaatacaagacacgagcttctataccattgctaagtacaatgcttcttctcataataccgctgatcgcttaaatgaagtgtggattaaagtgtcaggagtcaggactgaatattgctaacggttgtttccatcggttaagtgcatgcagtatcctgttttagtgtcattgtgcttggagtggcttgtttcagtggtgttatgtgtgaaatgtgttgttttcgttgtgggtccaatgtaaataatgctagctcccgcttggaatatgcatgtatgacttgaatacgcattgctattaatagtaaataaatatagactttaaatatgtttttcatatttataatatactttttttcatattgttatctattaatttttttttaataaaaaaaaactgttaattactatattgttcctaaaatagttaattaataaa

SEQ ID NO: 254 - DNA, 4135 bp, Glycine max
  misc_feature (1)..(4135): Glyma.11g218000.1
cctttcttcccgaaacacgttacttacacgtaggcactgaattccgtggcaacgcgcaaacctcacctcactgagtagtagtcattggggcggactattagaaaacactttagtaattgtttttgtgtgtgtgcagcgtcagttacccaaccctaactaaacacacacacactacactgagctcagagtgaagaaagaaagagaagagaagtagtaacagtttcaatcagttgaaagaagaagaagatcgagcattctttactgatcggagaaatgggagatccagcggaaaggttgggatcggaaggattggattccggcgccgccgtcaagaccgacgacctgtgcatggaaatcgatccgccgtttcaggaaaacgttgccaccgccgaggactggcgcaaagctcttaacagagtcgtccccgccgtcgtcgtcctccgcaccaccgccacccgctccttcgacactgagtccgccgccgccagctacgccaccggttttgtcgtcgacaagcgccgcggcatcatcctcaccaatcgccacgtcgtcaagccaggtccggtggttgcagaagcgatgtttctgaaccgcgaagaggttccggtgcatccgatttacagagatccggtacatgattttgggttcttttgttatgatcctggcgctatacaatttctgaactatgaggagatacctcttgctcctgaagctgcctgtgtaggactagaaatcagagttgttggtaatgatagtggtgaaaaggtttccattttggctggtactcttgctcgattggatagggatgctcctcattataagaaggatgggtataatgacttcaacacattttatatgcaagcagcatctgggaccaaaggagggtcaagtggttccccagttatagattggcaaggcagggcagtggccctcaatgctgggagcaagtcatcaagtgcatcagcattctttctacctctagaacgagttgtgagggcattaaggtttcttcaaaaggaaagtgaaacttatgttgataaatggaaggcagtttctatacctcgtggtacgcttcagatgacatttctccataaagggtttgatgagactcgtcgacttggccttagaagtgagacagagcagatagtccgtcatgcttctccagctggtgaaactggaatgcttgttgtggactctgtggttccaggtggtccgggttataaacatttggaaccgggtgatgtacttgttcgtgtcaatggagaagtcattactcaattcctgaaactggagactctacttgatgacagtgtaaataagaatattgaattacaaattgaaaggggtggcacatcaaaaagtttaactttgttggtgcaagatttgcactcaataacgcctgattatttcttagaagttagtggggcagtaatacatcctctttcttatcagcaggctagaaacttccgtttccattgtgggcttgtttatgtggccgaaccaggatatatgctcttcagagcaggagttcctcgccatgcaataattaagaaatttgctggtgaagaaatatcatgtcttgacgaactgatatcagttctttctaagctatccaggggtgctcgagtaccattggaatatataagctacatggatcgtcatcgaaggaagtctgtgttagtgacggttgatcggcatgaatggtatgcaccacctcagatatacactcgtgatgacagtactggtctttggaatgctaagcctgcttttaagcttgattcccccttcctatcattgggtgctaaagatgttgaaaatctatctagacagtcagtttcactaactggtgagcatgcttgtgggggacatgtgtgtggagataacagtcaggagttggttgatggtgtcactagcatggaaaccaattgtgaagatccctcagagtgtgtatctcaccacaatgcatctgatggtgtggtgaaaaaacgaaaagtggatgaagatttatcagctgatggaaatgttgttgctgatttttccttaaatgactcaagggaaactaagctagaaaaatcaagtattatacaggatgacatgttaatggactatcagggtgcaactgcagctacagcaaatgcatcagttgctgaacgtgtgatcgagcctacacttgtgatgtttgaggttcatgttcccccatcttgtatgcttgatggtgttcattcacagcacttttttggaactggtgtcataatttatcattcccaagatatgggattagttgcagttgacaagaatacagttgcaatatctgcttctgatgtaatgctatctttcgccgccttcccagttgaaattccaggagaggtggtatttctccatcctgttcacaattatgcccttatatcatatgatccctctgcattgggacctgttgggggttcagttgttcgtgctgcagagttacttccagagccagcattacgccggggggattctgtttatcttgtggggttgagtagaagtctgcaagcaacttctaggaaatcagttgttaccaatccttgtgctgcattaaatataggatctgctgattcccctcgctatagagcaaccaatatggaagtaattgagcttgatacagattttggcagtacattttcgggtgtgctaacagacgaacaaggaagggtccaagctatatggggaagcttctcaactcagaagaagtacaagagaagaaagatgaaaactagaaagagacgagagaagacaaattttacacaaacctcaaaaggctacctgatgctgaaatttggttgcagcacctcagaagatcatcaatttgtgaggggtattccaatttatgcaataagtcaggttcttgacaagattatatcaggtgcaaatgggtcacctcttcttataaatggtgtcgaaaggcctatgccacttgtgagaattctagaggttgaactttatccaacattgctttcaaaggctcggagttttggattaagtgatgattggattcaagcacttgttaagaaagatccagtaagacgtcaggttttacgtgttaaaggttgtttggctggatcaaaggctgagaatcttttagaacaaggggatatggttttagcaatcaacaaagaaccagtcacatgcttccgtgacattgaaaatgcttgccaagctttagacaaatccgacgccaatgatgggaagcttcacttgactattttccggcagggacaagaggttgaactttttgtgggaacagatgttagggatggaaatggcactgctcgtgcaattaattggtgtggttgtattgtccaagatccacatccagcagtgcgtgctcttggatttcttcccgaagaaggtcatggtgtatatgtggcaaggtggtgccatgggagtcctgtacataggtatggtctatatgctcttcagtggatagtcgaaattaatggaaaaccaactccaaatatagattctttcgttaaagtgacaaaggaactagaacatggcgagtttgttcgtgtaaggacaattcacctcaatgggaagccacgagtcctaacattgaagcaagatttgcattactggccaacgtgggaattgagatttaatcctaatagtgcgatgtggcatcgcaatataatcaagggattgaactgcagttctgtatgaaatatgaatgatcagaccatgtaattctttctaattcctatgtacgcagctacacgggagtatagaaaaatctcgtggaaggcatcttccaggttcagaattatggtttaccagtgccctcgttgcaaatttgaggcaaatttgatgctttgccgttaaggggtctacttcaattggttgaacagatggagagagatactataaaacattttgtccaaacatattgtattgcattgccatgattgataagttatgaggcgttcgattcaggctggcaattatttattcggatctgtaccgcaacatataacagtaggctaattatattggatcctggaaaggttggataataaaagaaaaatgaaaaatatttatagtttatgtattgaaggaaaaaaaaaaacacaccttttctttggtttgtgaatattttacc

SEQ ID NO: 255 - DNA, 1477 bp, Glycine max
  misc_feature (1)..(1477): Glyma.06g286700.1
ggttttataccccaaacctagctacgcctactagttcagatatcaaattagctatggcaacccaaagtgaagaaaatgctacaaaattccttcaagcttatacccagattgatgatcatagtttgagattcatacactccatgtcccttaaatgtgcaattgacttaagcataccagacatcatacacaagtatggccaacccatgccactctcacaactcattgcttcactaccaatccacccatccaagacttgctacatccatcgcttgatgcgactctttactcattccggtttcttctctcggcacgatttggtcgaaaacgaacaagaagtgatcacgtatgagctaactgatgcatctagactactcctcaaggaccacccttttagtttgaggcctttgttgctagtcacacttgatccaagtgtgattaagtcatggtgtcaattctctacttggctcacaagtgaagaccgtacaccgtttcaaacggagaatggggtgacatattttgattatgctaagcgtgaccccaaattcggtcacttttacaatgatgcaatggctaaggacactcgattcgcttctagtgtggtgattgaaaactacaaggaagtgttcgagggattgaagtcaattgttgatgttggaggaggaatagggaccatggctaaggccattgctaaggcattcccacaagtgaagtgcactgtgtttgatctcccacatgttgttgatggcttgcaaggaacagaaaacatagaatatgttggaggagacatgtttgaagtaattcctgcagctgattgcattatgctgaagtgggtattgcattgttggaatgacgaggaatgcatgaaaatattgaagaaatgcaaggaggcaatacctagcgacggaaaggttatcatcatggaattagtgatggagcataacaaggaagacaataaattaattgagatgcagctgtgctgtgatatgcttatgatgtcgctttttgcaggaaaagatagaactgagaaagaatgggcacatctgattgcctctgctggtttcagtaactacaagataactcatattttcgatttatatcatatcattgtggtttatccctagtgtaggggtggaaatgagtcgagctgcttgtcgaggatctttggctcggcctatgtaaggttcggcttggctcggcttgtttactataaaggtcaagctcaagctttttaaaaagtttttttagataaaaaggccaagctcaaactataaaaaaaagcttgttaaacttgacaagccaacttgtttaactaacaataataataataataactttattttatcaaatcttattctatctagattttattttatccagattttattccatctagattttatttcatccaatcttatcttatcttgttcagattttattttatttcgtttatgggcttggacttaaaatagatttgtga

SEQ ID NO: 256 - DNA, 3982 bp, Glycine max
  misc_feature (1)..(3982): Glyma.06g126000.1
atggcatcggtatccagtcaaccacagttccgttacactcagccaccgtcaaaggttctccatttgaggaacttgccatgggagtgcacagaggaggaactgattgagcttgggaagccgtttggcaaagttgttaacacaaaatgcaatgttggggcgaatagaaatcaagcttttattgaatttgcagatttgaatcaagccattgcaatgatatcgtactatgcctcatcatcagagcctgctcaagtacgtgggaaaactgtatacctacaatattcaaataggcaagaaatagtgaataacaaaactactgcagatgttcccgggaatgtattgttggtaacgattgagggtgcagatgcacgtcttgtcagcattgatgtcttgcacttggttttttcagcctttggatttgtgcataagattactactttcgagaagacagcaggatttcaggcactggtgcaattctcagatgcagagactgccacctctgcgaaggatgctttggatggaagaagcatacctaggtatctgctgcctgagcatgtgggaccatgtacccttaggatcacttattccggacattcagatttaagtgtaaagtttcaaagccacaggagcagagactatactaatccttaccttcctgttgctccatcagctgtcgagggaagtggacaggctatggttggtttggatgggaaaagattggagactgagagtaatgttctccttgcatctattgagaacatgcaatatgctgtaacattggatgtcttacacatggttttctctgcttttggccctgtccaaaaaattgcaatgttcgataagaatggtggtttgcaggctctgattcagtatccagatactcagacagctgttgtggccaaggaagccttggaaggacattgcatatatgatgggggtttttgcaagcttcacctttcatattcacgacatactgatctaagtataaaggtcaataatgataggagcagagactataccattcctaatacccctattgtgaacgcccaaccctcaattttcgggcaacaatctgtttccatgatgggcccttcacaacaaccattctatgggtctcaggctggatgggggacagctccaccagcagcgatagataaggtgatactcttagtagctcttccttcacacattcattcctcctctgctccgagcgaagaagaagaaacaataaccattatggccacacttcaagcctcacttctctgcagaacttctctcccatttagctctcaccatcctcaactctacaaactccatcctcactctttcaacttcctatctccatgcaaaatgtttcagccgcgccttcactcttccgtctctcgcagcgtcgcttcccgctcccaatccaatccctccggcgccgattctagtgtaattgaaaacgaagcgactccgagtgtcgtcgacgctgagagttccgatccttcgatcggagaggaaaagagcgagagtgcaaaagaggaagagaggttgccgattgtggcgttgtacgagggagcgagagagagtgttgaaaaggctttcgccgatttcatgacctggttgcctctctggcagcaggagaggcgtttggctaggttaattgttgacgccgaggcgaatcccaatgatgtcgccaaacaaaccacactacttattgaacttaataaacacagtcctgagtctgtcatcaagcactttgaaggaagggagggtgctgtagacagtataggagttgtagaatatcttcgagctcttgtggtcactaatgctattgctgaatatctgccaaatgaggaatatgggaaaccttctagacttcctaccctgttgcaagagttgaagcagcgagcatcaggtaaatcagatgagcctattcttagccctggaacatctgagaggcagccattacatgttgctatggttgatcgcaaagtatcacagaagtcacgttttgtacaagatcttttgtcaactatattgtttattgttgttatgggattggtctgggttgtgggtatggttgcacttcaaaaattcatagtaagcttgggtgggattggaacttcaagtgttggctcaagtagtacatatgctccaaaggaactaaataaagaagtggtgccagaaaagaatgttaaaacatttaaagatgtgaaaggttgtgacgatgcaaaacaagaacttgaggaagttgtggaatacctgaaaaatccagctaaatttacccgccttggaggaaagttgccgaaggggattctcttgactggaccacctggaactggaaaaactcttctagccaaggctattgctggagaagctggtgttccatttttctatcgggcaggatcagaatttgaggagatgtatgttggagttggtgctcgacgtgtaagatccttatttcaagcagcaaaaaagaaggctccttgtattattttcattgatgaaatagatgctgttggttcaactaggaaacaatgggaaggtcatacaaagaagacattgcaccaactacttgttgaaatggatggatttgagcagaatgaaggaataatagtaattgctgcaacaaacctgcctgatattcttgatcccgctttaacaaggcctggtagatttgatagacatattgttgtaccaaatccagatttacgtggtcgacaagaaatattggagctttaccttcaagataaaccattggctgatgatatagatattaaatcaattgctcgtggaaccccaggattcaatggggcagatcttgcaaacctggtaaacattgctgccattaaagctgctgtcgaaggtgcagagaatttagcagctgcacagttagagtttgccaaagatagaataattatgggtacagaacggaaaacaatgtccatatccgaagagtcaaaaaagcttactgcttatcatgagagtggccatgcaattgttgctattaacactgagggtgctcaaccaattcacaaggcaacaatcatgcctcgtggatctgctttaggaatggtcactcagcttccctctggtgatgagacatcaatcagcaagaagcagttactagctcgtcttgatgtttgtatgggaggaagagtggcagaagaaattatctttggtcaggatcatatcacaacaggagcaagtagtgatctccatacagctactgagcttgcccagtatatggtatcaatttgtgggatgagtgatgcgatagggccaattcatataaaggagagtcctagttctgacttgcagtcccgtattgatgcagaggttgtgaaacttcttagagaagcatatgatcgagtaaaagcccttctaaggaagcatgagaaggcattacatgctctagcaaatgcattattggagtatgagacgcttaatgcagaagaaatcaggcggatactacgaccatatcgggaaggaagactgccaaaggaccaggaacaagaagcagcagaagaggagctcgtgttggtctaaacattcttcctgtttgatgtctgttaactatactaactatagggggacgctctgtacagcatacctagtcacacaacaggtatatttcttgatccatttgttgcagatccactcctttgtgcatgctattctggccataagattttgataggaacttaagaagtgatacacctttgagtatatttgaagcaaccagtcctgctcacaatgacagacctgaatattgctcttgctaggagtgcgaacaacatttttttaagagaatcatttataatttgtagaaagatgtttgtttggaagttttgagaactgtgcctactagtcttttatttatttatttttgtgtgtactagtagtctacacattattcgttgctttaaaagtttattgtttacagatatccaagtatttttgttcacatgattaagttatcaattaaagtttgtaggaa

SEQ ID NO: 257 - DNA, 1072 bp, Glycine max
  misc_feature (1)..(1072): Glyma.08g036600.1
gcagaaaaggcatttggtcatggtgcttgtatttgaaattcagagggagcttatgttgctgcaaaggcatttggtcatggtgcttgtatttgaaattcagagggtgcttatgttgctgcaagaacgtctgtaaatactggtatgccaccagtagttgaagcagaagcatcctccttgctagaagccattttgtgggctaaggagttgtactttttgaaatagattgcaagcatctatttgaccgtttgcatgcgccaacatcattagataatgaattgggagcttgtacttggcgcagaacaaggaagggacttctgaaaatggtcctgaaacacaagcaatctcatcaaatcggaccaagatgcaaggaaggacccaagggagaagacaaatactgtgcagaatccttggaaaccctaatgaactttgtcatttcaaagcttggaaagaacgttcaggcattttcaagctccttcttgagtaagcaagaggaatacacagtggagggagtgcataatcttggaggcaaagcagtgatgtgtcataggttgaatttccaaaaggctgtgttttactgccatgaagtccatgaaacaacagctttcatggttccattgcttgccggtgatggaaccaaaactcaggcacttgctgtttgccactttgatacttcggtcttgaactttgaattgttccgtcaaataatgaaagttgatcctggaactaaccctctttgccatttccttggaaacaagtccattttgtgggttcccaatttagccacggagggtgcctctcagactaaaattgttgtttaattagtgcatcttgggcaccatcagaaatgtgtgtattataaataaattataatgtgatgttgtgtatttctgcccgccggcactaccctttttagcttagagctggaaatggagctacgaacctacgtgtactgttgttagtttggtaccccaccgaagcatgattcatctcgtgatcgacatgctttcatgatgttgtgatcattaataatgcaataaaaatgtaccgtgtttcatgttctaatacttttttc

SEQ ID NO: 258 - DNA, 742 bp, Glycine max
  misc_feature (1)..(742): Glyma.13g328200.1
gtgtatcggtcataaatggttagtggataggacatgcgagacgtcacacacgcttaccaatgctcataaaacagaacatcactgatcacccatgatgtccttgcactttagctgttctgttacaaagaaagaacaccaaataatgcagtccatgttaaccatccgtgccacccatggccttcctctgtgtctctcagggatgattcaccctcttgctctctctcacgatgtgtgtaggatagcggatcacgaccgtaggagacgcaccatgaggaagcaaaggcaaagatcactcaccagagagggtgtagtgcatgatgcggttcgagaaattcactttgtggaggtcaaaggtgagaccgatttgcatgatctctcccacactcatcacctggggttgtcagcaagagctgcttaaaatttagctgcttctccaaaattgattaatctcgctagctcctaccactttgttatgcactttatttaatttcactgtgatggactctttcgttattatatatatcatgttaattaattactagttgtctcctttgttctgtactcaattcttattttctgtaaccacatatgtggaactttttcttgtactcttactcccatgattaatatattcttcttatgatgttgcatatatgatgctagtatatgcaccttccattgtcatgtgggcacttcaattagtactcaaaatttaatctcaaaaaattggtccagttagtct

SEQ ID NO: 259 - DNA, 3424 bp, Glycine max
  misc_feature (1)..(3424): Glyma.05g143100.1
ttggtttcttgacttactcctcaatctcattttcatttgcttcggaattcgagaaatgagggaagaggttatcagctcaggaggcacccttgatccaacacctgctgccagttctgctggggcatcatccccagctgttccgaatgttggcagcatagatgggtcaagtcatggacaagcctctaaagcggcttctctctcatgtgttggttcacaaccaccatggacttccttgagcacaagtgctggtggttctgcttttggttcttcaagatcttcgtgtagaccttgggaaaggggagatttattaagacgtttggctacatttattccttcaaattggcttgggaagcctcagatcatcagttcattggcttgtgctcagaaaggatggatgaataatggtgtagacaaaattgcttgcgagtcatgtggttcttgtctgagttttacagcattgccatcttggacatcagctgaagctcaaaatgccagcaaatcctttgccaggcagctggatttggatcataaagttaattgcccttggaaaggaaacagctgtccagaaagcttagtgcagttccctccaactcctccatctgccttaattgggggctacaaggatagatgtgatggactcgtacaatttcactgtcttcctgtggtagccatctctgcaattgagttgatgtctgtttcttgtggcccacagattgaacgctttctatcacagtctcagaattttatgtcaggagaagtagacatcaaaccagacattatatctgagcttcaaaattctcaagatgaggcatactgtttatattctcgtgcacagaagcttataagcctttgtgggtgggaatcaagctggcttttaaatattcaagattgtgaagaacactctgcccaatctgaaagaaatggatattctttaggcccaagcaagactcaacttcatcttactcaagatcctgggtcaaaggcagtttctgcttctactaaattggatgccagaaaggcaaaggcacctcttaaggagtctagacttgactctaggttacctttgcttgattgtagcttgtgtggcgctacagttagaatttcagattttctgacagttcctcgtcctgctcgttttgcatctaacagtatagatattcctgattctagtaaaaaaataggattgactcgtggagcaagtgcagctagtggaatcaatggttggattgcagctgatgatacagagaaagatcagactgaagaccgtgacgaagttgcaacaacaaatgaggggaaattgttggcgaacacggatttagatttaaatcttaccatggcagggggttttccttttactcctttgagcaggacagcaacatctgaatatactcacgatgatatgggaagggatttaatgatcggtcagccttcagggagtgagattggtgatcgtgcagcttcatatgaatcacgtgggccaagctgtcgtaagagaaatcttgaaaaaggtggatgctctgataatcggcctgttcttaggttgcaacagcaggctgatagtgttgaaggaattgtcattgatcgtgatggtgatgaagttacagatggtggacaatattcagctggtccttcaaaacgtgcacgtgactctgatatttttgacacatattgttcacctcttcgaagagactcatctggtgctggcccaagtcattcaataggtttagaggcttacgctactggaaatcgaatttcttcataccatcaaggtagtgaccgcccaatgggtatccaatcagctagggactcaacccgtgcatcatctgtcattgcaatggacacaatatgtcatagtgtgaatgatgattctatggaaagtgttgaaaactaccctggagatcttgatgatgttcatttcccctcctctagcatatacggcaatgtggacatgaatgaaacatctgaactgaataacagcaatcaagctcagcaaagcacttgcttacaaacagctactgaagttgcacgtggtgatgtgggtgtcagtagtacaaactatggggaagaacttttcaatgcagaaactgtgactgctcaggctcgtgatggaattagtttgggcatcagtggagggagtgttggaatgtgtgctagtcatgaagctgagatccatggggttgatatatctgtgcacagagctgatagtgttgttggggaaatggaacagagagtagaagatgctgaaaatcagggacagacaggtgaatctgttccagatccaggtctactggatgagattatccctgatatgaacagggaagatcctattggtgatagccaggagatgatgtctcacactgcaggaagaacagacagtgggtcaaaaattggctgttctacaaaggcagaatctgttgaaagtggtgaaaagattagtcaaaactgcaatcttctacctgctaatagtagtcacccatctcattcttgtaatgctaacatttattctggttgtgaaaataccaaggaagggctcatgaaggatggtaaatcctcatttgccaacaatcatgctctccctaaatcagattttgccattgcaaatgggataggccctccaaaaggagagagtaattatgaagctgcagagtttgatcctatcgtgcatcacaatcaatgttgcccttgggtgaatggcaatgttgctgttgctggctgtgctagttctgttccaagctcaagtaatgatgcaattgccctttgcggttggcagctgacgttagatgctttggatgctttgtcgttggggcacaatgcaattccaacagtaccgtctgagtctgctgcatccttgtacaagcagaatgaccagcaagcacctggtcaaaaactctttcacaaccactctatgagccaaagccatggtcactctgagattttgtttcgagtattgggtgtttccatttccttgattatagaggcgtatttgaccaaactatacgtggtatgcttgcatatttcagtttcccttgcttaaagttcagtgagattgtagcagacatgttgctttactcccggctttttcacatgctaatgccacaagggaaaccggttattcagcagaacggggatcttgcatcattctgtgttgccaatcaatagtagttttttttttttttatcaaactatttatttacttaaaagacctgtagtttgagcattaaattaaaaattgtaaatactggaaattccttttatggcggaattgtgtcttggcctttggccctttagtaatgtgttaaattagatttttcctaaaaaatttcccttttgttgaaatttcaaatggtgtacattttttactactgaataaatgttaattttgtcatttcattactgaggtgatcatatatgtcaaattcaaaaa

SEQ ID NO: 260 - DNA, 1932 bp, Glycine max
  misc_feature (1)..(1932): Glyma.10g235100.1
cacagacaagggtttcttccgggttcacgtttcacaatcactttttgcgcttctctcactcactcactcttcttcttcctcttcgtgtggttttctttctcgaactcgaacgaagatgcgtgagattcttcacatccagggagggcaatgcgggaaccagatcggagccaagttctgggaggtggtgtgcgcggagcacgggatcgattcaacggggaggtaccaaggggacaacgagttgcaactcgagcgagtcaacgtctactacaatgaagcgagttgcggaaggttcgtgcctagggcggtgctcatggatctggagccagggaccatggacagcgtcagatctggtccctacggtcagattttccggccagataacttcgtctttggacagtccggcgccggaaacaactgggccaaaggtcactacaccgaaggcgctgagttgattgactccgttctcgacgttgtcaggaaggaggcagaaaactgtgactgccttcaagggtttcaggtttgccactctctcggtggtggaactggttctggaatgggaacactgttgatctcaaagatcagggaagaataccctgaccgaatgatgctcacattctctgtgttcccatcccctaaggtttctgacactgttgttgagccttacaatgcaaccctatcagtgcaccagctcgttgagaatgcagatgaatgcatggttttggataacgaagctctctatgacatctgcttccgcacgcttaagctcaccactccaagctttggggatctgaaccatctaatttcagccaccatgagtggtgtgacatgttgtcttcgtttccctgggcaactcaactcagatcttcgcaaacttgctgtgaatctcattcccttccctcgtctgcactttttcatggtgggttttgccccactcacatctcgtggttcccaacagtacagagctcttactgtacccgaattgacccaacaaatgtgggatgctaagaacatgatgtgtgcagctgatcctcgccatggtcgatacttgacagcttctgcgatgttccgtggtaagatgagcacaaaggaggttgacgaacagatgatcaatgttcagaacaagaactcatcatactttgtggaatggatccccaacaatgtgaaatccactgtctgtgatatccctccaactggtttgaaaatggcatcaaccttcattggcaactctacctctattcaagaaatgttcaggagggtgagtgagcaattcacagctatgttccgcagaaaggccttcttgcattggtacactggagaaggtatggatgaaatggagtttactgaagctgagagcaacatgaatgaccttgtgtccgagtaccagcaataccaagatgcaactgctgatgatgagggctatgagtatgaagatgaggaagaacctcaggaagatgaggtttaaaacaatagtagtgatttgcagggtgttcttgtttgtgttttgttgtgatactctgttaatgttgtgtttttttcatcccttgacctgaatatctttttcgggattttggattgttttggggcactctgtgtctgtcttcgtggctggatttcgtagtgtttagggattttatttttctgcttgttttcattattgttaacatggtgccctctgattgaaacgtagttgatatattcttattaactatttggatatcattcttcatgtcaaggggtttgatccttgcaccacaacttgtttggattcccagttttagatggtttttcaatcgttttttaagggtggtgcgtgaattggcaatgccaaacatggatgtttgttatgtatttggataacataattatgttgctttacttgaaaaattaatccttaaaataatagtgaagtttaacacaactgtttggataaca

SEQ ID NO: 261 - DNA, 2635 bp, Glycine max
  misc_feature (1)..(2635): Glyma.04g057200.1
agtagtattctctccaatctcgaataccagcaacaaaaatattttcttcttaataagtgtaaaatatatttacccaagtaaatattaaggaaaaacaaaagagggttgaggttactttcttcccaaatcccagtcaggcagatctaattaattcattgaataattgtgaacagtatacagtaaagagtgtgattttgtagagagccagagaggtcaaatcgagtggccaaaggttgggtgtcttgtttcgtatttttgtggtgctgctgctggtattggctaagaggctttcaaacagaatccattgagagaaaaaaaaaaaaagatgtaagagagagaagaaggaaaccccaacccaataatcatactcgtacttgggatgatattggatcatctcaacctcaattttctacaatattaaataaacaatcaccttcattttttttttctcctcttcatttctgatctcatccccatggatccctttgatttaatacgcgaagggtttggttgaggctgactggacatgcgctgttactacttttaaagtctgtttatgctgtagttattttgtccatattttagttaataatgaacttatccaagaaaggacccctaagggatgcaaagctattaaggaaaacaaggcaacaactctgaatccaaatgcagcagagtttgtttcttttgccctcagatcatcgtcattatctggaactaccagctcggtagatgcaacagcaaagctttctgctgctggagctcttgggaaagcagtttttgatagatcagaatcatccatttcaaataattctgatgatgaggtacaccaatactggcgatgtcagctccctgatgatatcacccctgatttcaaggtcatgggagaagatgagtctcgagttcttgatgatctttctttagcaggcttatccatacatgatgacaatgaagcctccaggtttccttcttctaaaggaagtaaatatattataaatgagcaggaggaaatatctcaacagcatgttaatggcaatagcttggcagataaactagggttttccaattcaagctacagggaggacccatcttctggaagctttttgaatgttctggcaaagccttgggaggggccaattgggagtgctgaccagtgtattagcagtggtcaagagggccttacttatgatgacaactctatacatggatacttaaatgatgttttggttgaaaatgcaattgtggatgatactgatctgaatcctttggagtttttagcttccctgttccctggttttgcagcagaaagccttgcggaagcttactttgctaatggatgtgatttacatctgaccactgagatgctcaatcagttagagcttcaagttgatggcggtttcaatcagaatctgaattcaaagactctgtcagctcccaatctcagtgcaatggactaccctgcacttacttcaccagatggccagactgcttcagtaaaatatgtggttgataatgtccaacaaagtggcaatccttaccgatcatttgacagtgatgtgctgcttttcaaatctggctcttcagttccatctgggggtggtgctattgaatttgcttcagctgttaggaagttggcttctcaggattctggtggtatttggaagtatgaaaaaaatggctctggtgatgctgctatcggctcaagtaggacttcaaatgttctggctagtgattacaatggtggacaggggagagcacactttgttgatcggttacagaacgttggttcagctcgggcagctcctgtttggcttgaaaccagtgatgcagttgcaaatatgttttcagagctgcgggaagaggctcgcgatcatgcatgcttacgtaatgcatattttgagcaggcacagcaagcctatctaattggtgataaagccctagcaaaggaactaagtgctaaagggcaactgcacaacatgcatatgaaggctgctcatggaaaagctcaagaatccatttaccgccagagaaatccagttgctccagaggtgcagggcaatggaagaggaaatgagaggatagtagacctacatgggttgcacgcaagtgaagccattcatgtgctgaaacatgagttgagtgtgctgaaaagcactgccatagctgccgagcagcgtttgcaggtttatattcttgtggggacaggtcatcataccaggggttctcgcactcctgcgagacttccaatagctgtacagcgttttcttcttgaagagggcattgacttcatggaaactcagccaggcctactacgtgttgtgatatattgaaccagccaagaatgtgtacaagttttttgacacagtataaagtccaccaacacggacattttagttattgttgtatctgtatatgcccgaagaacaggaaaaaaaaagaagaaaaaaacagttaggggagaaggaaagagaagggttgtagcagaattgtatcgttaaggtttaggggcagcgtcattttccttccgttaattttgtaccctaattttttttttttattcagatgtaactgatagaattcaattaccctatagaacaattgattttccaaattagattcaatgccaaacaattta

SEQ ID NO: 262 - DNA, 2021 bp, Glycine max
  misc_feature (1)..(2021): Glyma.07g107300.1
aagattaagattagatattaagatggcgtgcagaccactgtctccccttttgctctcttcattttccattcgtagacgccaagaaccctaacagatcaaaacaaagaagctgaaacctttggggtatgaggttttgcatgtctacatttatgggatttgtgtaatttacccccttttctggtttgactttatctgagctgaaacaatggcaagtttttaggagaatgcagtggacctggataatttgtgaggatatttaacatcgtgtacattgtgctcctttaattattttcatcagttggtgttgtgatggatggtgataatggtcttaacatacgtaattggggttactatgaacccgctacgtcgtttaagagccacctggggctgcagctgatgtcatccttgccggaaaaacctttaattggagggcgcaatgctgtggttttagctggcactgatggggcatttcaccatagggacattggtggtatgccccaagctacataccctatcgaatacatgagggatacatggattagtcagagagacaaatatatgaatatgatacctacaaaccataattatggtggtattccggagacatcttcagcacatcaaattcaaatgattcaagcaccggaattgccaaaggaagaaaagccagtggaagaagcacctgtcgtcaagaaggcaaatggaactcgtaagaaaagacaggggcccaaggttcccaaatctcccaaggctaagaagccaaagagggtgcctcgtgcgccaaaggatgagaatgctcctgcagttcaacgtgcaagggttccgaagaaaactactgaaattgtaataaatgggattgatatggatatttctcgcattccaattccagtttgttcatgcaccggggcaacgcaacagtgttataaatggggatctggtggttggcagtctgcatgttgcacaacaggcatgtcggtatatcctttgcctatgagtaccaagcggcgtggtgctaggattgctggaaggaaaatgagtataggagcatttaagaaagtgttagagaaactcgccgccgagggttataacttttctaatccgattgatttgaggacttattgggcaaaacatggcaccaacaagtttgtcaccatcaggtagatctagtctgtggccatctggcctgttatgtcttttagcctgtttgtgatgtatatacatgcgtatttggccagagacagactttttagctggtttgtagtacaacaattttcaaattcattagacatcttgttttgtcttctaactctctttgttagtatcttcactttattggatgtagtacatgggaactcatctatcggttggttggttcagattgggaactacctgatgagataccaagctgtctgttgtgtaaaaccataattaaaatatgcctactgttcatgacctgtgaaagctgggttggaagggaaaacacttcacgatgcattaaaatggtaatgtgtttctagatggtccgattgaatggatgcttcatcattgtttaaagaaagtgtggaaaacagtgtttaatgttttatccagaatatttttcttttttactgtatttctttcaaaaatgaataaaagtacttacatcctagcattgctattttgaacgatatgtgataaggccattgtagaaccataccacaaaagctagccattgtagttggagacccaaggtcttttaaccccatacctgaatttcatttttccaatttgggattcaagtctcataccttgcaattggacccaaacaatttgatctccaaatcattttaaattcctgatagatgcagttcagttttcagagaaacaggttttttgaactgtgcaggtaagatggttgtcatagtggcggatttttttttatgcaagtctggttatgggaaatttattttgaatcaaatcatgacttttatgtgtcaaatctgaattggtattaagttcatgctttatgcttgattaaaagtttc

SEQ ID NO: 263 - DNA, 2330 bp, Glycine max
  misc_feature (1)..(2330): Glyma.18g085200.1
tgaatctgatgcaagaaaacctttcagaaagaagaaagagggacgaccaaatccacgtgttatcaccccattggcctgtcttcgttaaagaaaaaaaaaaaaacacgcacctctccttccttccttccctcttcgccccacaacacaaactctgtcgtggtcaccgtagagagagaaaaacaagagagagaaagtgagggtgagagtaggagtgggagtgagtgagaagaagaagaagaaaccatgaacaaaagaaccacgttgcttattcgaaccctcttgttcctcttcgtcctcaactccctctatctctccctctacttcacccacaaaccctcttattcttctccttcagaagaaaaagaaaaatcagaactcgaaccagacacatacctaacacccttttcacacgaacctcactcttcaaagccatggcctattctcccttcctacctcccctggaccacttctgcgcgatcccactcctgcgaggcctacttcgggaacggcttcacgcggcgccgcgacgccctccttccccgcggcggcgcggggtggttccggtgccaccacaacgacgcgctccgtagctcggtgtgcgagggcgggaggctgcgcatggagcctgagaaaatcacgatggcgaagggtggcgaggatttggcggcggttatggggcgcacggaggacgaggagatgcccgtgtttcaaaacggtgcgtttcaggttgacgggggtgaggtcgccgttgaccggaaggttctggttgaccaagagtttttggatgagtatgtgccaaggggagggattgatagacacaccatgcgggatttgatcgccaagattcggatcgtgagagggaaggattttcaatgtgatgagtggattgaggaaccaacacttctggtgacacgctttgagtatgctaatctttttcacactgttacagactggtacagtgcttatgtttcttctagagtcaccgctctgcctaatcgacctcatgtgatctttgttgatggccactgtaaggctcctcttgaagagacatggaaagccttattctcaagcgtcagatatgctaagagcttcagtggttcagtttgttttcatcatgctattatctcacccttgggatatgagacggcaatgtttagagggctttcagaacatatagattgttatggagctcctgcacaagaactattgcaaaaccctaatgaccacaaaaccgcgcgcctttctgagtttggagaaatggtcagagcagcttttgggctacctttaaatgtaaaccatgatggaaaaccactcgctggacataatgtcctctttgttcgtcgcgaagattatttagctcatccacgtcacagtggaaaacttgaatcacgactaagtaacgagcaagaagtcttcgactcgttgaagagctgggcatccaattataaagggtgtaaaattaaccttgtcaacggattgtttgctcacatgtctatgaaggatcaggttcaagccattcatgatgcatcggtcatcattggtgcccacggtgctggtcttactcatatagtatctgcattgcctaaaactgtgattctggagatcattagcagctattacagacgaccacattttgcttatatttcgcggtggagaggattagagtatcatgcaatcaaccttgctggatcacatgctgatcctggagccgtgatcaaagaactggcgaacataatgaaaagccttggatgttgagtgttttggggttgaaactgctgatatctgagcttgagtggtggaatggaaggtgatctgtaattttctgattcacatctcatacgtggcttgcaatgttttttcctttcattgcggccagttttgttactacgaaggtgcttgaaagttgctgatatcttgttggagcagaaatagcataactcttctaaactgaatttaacttgacaattctacaatacccttgaagatgcagaatcagaaccatgagagaaaggtccatttgtcttggtttatattgcatgctggattgttagtacatggcacagtatgtgacatcttgcagtggattttgtttccttcactttctccttgctagtacctggcacacagtatacagaagaggggtctcaattttaccccgctttgttgtacaataggctttttcacgagctcatattttctgtgtattttcgatacggattctatgttaattgttgaggtaatccgtatagattgaatttgtacgtgcattaagcttttgcctgatataattttcagtgaacttgtttgtctgaagtatttaatgcatacag

SEQ ID NO: 264 - DNA, 1619 bp, Glycine max
  misc_feature (1)..(1619): Glyma.04g190500.1
aaaaagtagtaattaattatataaaataaaaataaaaaggcgagaagcgagagtaaggtcaggttcagcttcacagtttcacaccaaaaaaaggtgaatgtgaacactgaacaacaaagatgggtgccgtgacctcttcaatggcggccaagctggcgttcttccctccttctccgccgtcctacaaggtgctgaaggaggaggccacggggctgctgctgatggacccgttcccgcaccgcgagaacgtggaggtcctgaggttcccgaaccgccgcggtaccgagatcgtggccattcacgtgcggcaccccatggccaaatccaccctgctctactcgcacggtaacgccgccgacattggccagatgtacgagctcttcgtcgagctcagcatccacctccgcatcaatctcatgggatatgattactctggctatggacagtcatcagggaagccaagtgagcataatacctatgctgacattgaagctgtatataagtatctggaagagaactatggtgctaagcaggaagacatcatcctttatggtcaatctgttggaagtggccctactttggatcttgcttctcgtttaccccgtctaagggctgttgttctccacagtcctatactatcagggctgagagtcatgtaccctgtgaaacggacatactggtttgacatttataagaacgttgataaaattccattggtgaagtgtccagtgctagtaattcatggaactgctgacgaggttgttgattgctctcatggcaagcagttgtgggagctatgtcaacagaaatatgaacctttgtggctcaaaggaggaaatcactgtaatttagaactctatcccgaataccttcgacatctcagaaaattcatatcctcggtagaaaagccgccatcacaaagagtgagtttcaggagaagcatagacagagttgaacaatctagaggaagtactgattgctttgaaacaccgaggaagagtactgatcagagggacaaaccaaggaaaagtactgataggacagataaactaaaatttcatgaattcaaatttaacaatacggaaaagttagagaagataagagtccaatttgatcagatggagaggtcacgaagaagcgtcgagtacaatgataaatcaagaagcattgagttccaagataaatccaggagaagtgttgatgttcagtttgagaggccacggaagagcattgattggctggatagaattcgagctagctgaacctcttgaagtataagtaatattggcactgggtttgctacatgggaggaaaaggtacaaagatacagacacagttacttacaccggggttttaacttatggtttgcagaatgcatattactcgtgcagtttcatactttcgttgaaatgttcatgtagatttggatatgttgggacttgggatttgatatccttaggtttttctgttattattatttgcaattgaagcgactctaaccttgttttagtcctgagaaagaaaatgaacatcatgtcaaaggtggctgttgctataatttataaaaattcaaatggattgaatatccttattgattttgccttcacttttcttatcgt

SEQ ID NO: 265 - DNA, 1246 bp, Glycine max
  misc_feature (1)..(1246): Glyma.18g209800.1
ttaaataattaactagttggaaaaagattattctaaaggatcaaattcacatagaaaataaataccatcttatccaacacacagagaaggaaaaggccgaaaaagcattccataggaatacacgttaaattatatacacagctctttaaatttccaaacttcaaagcagcttcgtagatcctcaatcatgtcttctatataagtacaaaccttcacccatctcacatatcacaacactgtcacaaaggaaaagtacttttttttttaaaaaaattatcttatttgagtgtgatcgatggcatacccaaacccttatccggcgcaaccgtatccctccacctccgtgccgatgccggcggtgcccaccgccgtgatcggcccccagttctgtgcgccctacccgctggatctggcggtggtgaagaaggtgatgacgctctccgacggtaactttgtggtcaccgacgtcaacggcaacgtcgtcttcaaagttaagggatcgctcatgaccctccgtgaccgccgcatcctcgtcgacgccgccggcaaccccctcgtcaccctacgccggaagataatgaccgcgcatgatcgatggcaagctttcaggggtgaaagcacagaggccaaagatctaatctttactctgaagcgttcgtcccttatccagtttaagaccaaattagatgtgtttttggccaataacacaaaagaagatgtttgtgactttaaggtcaaaggtagttggttggaacgatcttgcgttgtttatgctggtgaatctaacaacatcgtagcccagatgcataaaaagcacacggttcagagtattttgattgggaaagaccaattcatggtcacagtgtatcccaacattgattatgcgttcgttgtggcactaattgttattcttgacgagattaacgaagatgagaaagaagattagagaaatgctacacattcagcaaatcgtgttgtactttttatcgacggtggcatatttccactgaagctattgtgtttgtttaggtgtttcgtctttctaatttatgagtaaataaaaatatttaaattcgagctgcattcaaaaacatattatgtcatttgtgtggattcaatttcaattttcaaccacgaagcagccagatttggtattacctggcctatgattaaggtaagttttattggccataaagtaataatcaagttgcttcatagtaagatacttaaaattagggttttgtca

SEQ ID NO: 266 - DNA, 3180 bp, Glycine max
  misc_feature (1)..(3180): Glyma.02g021900.1
ttccatatacattcacgagtaaaaatgattattgtttttttaaaaaaaaatcacaaacagcgaattctatttgatgccccctcaataataaaatagatgccacccgaaaaacaaaaggttcaaactttcaagaagagaataatttgccaaaactttgcagtgaataatcttgaaaatgaaatcaagacagcattctcactgatcacgatcgcagctttcgatctccaccatttccctaggacaatatcgtaattaacttttcggtggtgcaatgaattttttgctgcggtccacgacgggcgtgtacagagagccttctccgtcgattccggttccggagccgcgtgttgatacgcatcataggtctgcatctgctggatcttctttggagaatcgtgtgtctgatgatccgtatgcgtggtatgatgcaagggttgttagtggcgtgttccttaagcacgtggatgttgctgaggatgaaggatgggttaccattccatgcaaggaacttcctgaaaactggacttgtgcaccagatatacagtctctgtgctctcttgatcgctcctttcttttccctggtgaacgagttcatatcttggcatgcttttctgcatgtaagcaggatacatcttcattcaaagttgatgcagtgacaagtgacaatggcataggtcacagccccaagaaagaaaatggaaacattgaaaacagaaacaattcagtgtctggagaaggggaacctggtaccagtgatgaagagcagatggaagatgtttctgatgatgaatcccttcttcaaaaagaggttctcaaaaaacaaaccgcattattgttgcaaaagtttgaaaattctcacttctttgtgaggatttctgagtctgatgatcccctttggtccaaaagaagctcttcagaaattttttccaactcttctgatgcaaatactgaaaaggcctcaacaatcaaatctaaaggggacacattttctcctattagtactattattgatagagggaattttgattcaaatgtttctggtggagtggcaagaaattctgtgaagtgttgtgctttacctaatggagacttagtggttgttttacaggtgaatgttggtgttaattttcttagagatccttgtatagaaattcttcaatttgaaaagcgtcaggagagaatgtcatctcctgacagcaaggtggatgcagcaaatcaggattcatgtgcagagctgttaaattggatgcttccgttggataatgggaggccttctacttacccgccatttcctcctcatttaacttcaacttcaggaattggtagctcctctcagggatccaatttttctggatcatctagctctcagttattctcctttggcaattttagaagttactccatgtcatcattaccgcaaaccatgagcactccatctgctcctgtcaaagcagttagttctaagccaaattttgaccttaaggattgggatcaaatctcatctcagaaatatttttggaaaaagatggggtttgaaggacttctatctttccgaggtgtttcactggaacaagagagatttcatgtttgttgtggattagaaggcctatatacaccaggaagaaggtggagaaggaaacttaaaataatacagccattagacattcattcttttgctgctgacgtcaattcagatgatcttctgtgtgttcagataaagaatgttgctcctatacatgctccagacattgtgatatttatagataccataactattgttcttgaggagtttacaaaaaatggatcactgtcgtcattgccgatttcatgtattgaagctggaaatgatcattctttaccaaatctagctctcaggagaggtgaagagcattcttttattcttaaaccagcaacttctatatggaagggtcacaagattcaggatgatagaagttctcaatggtcaaggatgaaacatagaaataaaacatcaaaactaagactcaacagacggaagactgctttaattaatgaccagtattcaattttggtttcatgtcgatgcaattatactgcatcaaggttgttctttaagcaaccaaccagttggcgaccacgtagctcaagggatattatgatctcggttgtgtcagagatgtcaggacagtctcttgctgcttatggaaaaacttgccaacttcccatacagatattaactcttcaagcttcaaatttgacctctgaggatctaactttgactgtgcttgctccagcctcatttacttcacccctttcagtagtctccttgaattcaccaacgactccaatgagtccttttttaggtttctcagagttattagtaagagtaaatggtgaaagaggaattggtgccacccagcgacaaagtttcactcttggtgtaaaagataatgagaaacaaagttatgatggcaaagcccaggctgtttctacgagtgatgatgtcattcctggttctgatcttagttgtacacatctatggctgcagagtagaattccacttggatgtattccatctcaatccattgccactataaagcttgagctacttccattgactgatggcataattgttctggacactttgcaaattgatgtcaaggaaaaaggtgttacctatatccctgagtgctcattaaagatacatgcaacttccagtatctccaaggggatatagattggaattggacgtatagctggtttcatttttcttgggtacagtagaaacaaaaaatggatgatgtgcatacttaaattttagaatttctcttgcaacttactcttaattgcacaaaatgggtattttgcttggacttcaaattgatctcgtgacttactgtcaatagctcaacagtagttatcttctgttagtcagttgagaattgtgtcggagttggcatgtcaaattgtgttagtagtttcacttttgctttgtaaaccacgagcttaaatagaagcttgttacgtacctctttaaggggaagaatgtaatcattatatataatactattgagctgcaactgagtgcattttccactgatcatctagttttcagatttttacacttttaagattggatggagggaaagagatagaggaatagagtttgttactttaaaatttcatttcgagtaaaaattc

SEQ ID NO: 267 - DNA, 2833 bp, Glycine max
  misc_feature (1)..(2833): Glyma.20g149100.1
ggggagagaaactcggttctcccgcctatccaattcttgaatccgctaaccccaactccttcttccctcattttttcatttttcatttttcacacacaacacaacactttcgcatgttttgttgatgtttcctctctcgctctctgcaaacaataatggacacgccagataggagcaagatcaacacccctctttcccaatttgaggattcgcctgtgtttaagtatatcagtaatctatctcctatagagcccgttaaatctgttcacgttactcagacattcaactcatatagcttttcatcccctccatctgttttcacatcaccccatggcaactgtcacaaggaatccagattcctcaggaggcataaccttttggagacatccaaacctaaggtttcgtctgaagatgtaaataatgtttattcatgtgaagagactcctgcagattcagctcaagcatgtcatgaatcaagtgagcaacaggaaaatactgctcaaaagatttccgttgcagatgcctcaattgagccatgtaatgaaaataaaaacccaaatatctcaattgagcttccacaagtcttaaaatataatttgggtagcccagggtatgaacctctactctatggtgatgaggctaattctcttttggaattgcctggcaatggcaagccagcatcagatgttgcttctgttccagaaggctctgaaaaagattcaattgagggtgaaatgcatcttccgggattatgtcagattgaggaggcaaaagttgaaggccaagattgtggtgtggatagtttgattactgaagcctctgatctgttaatgtttagtcccccagaagcttttaagggtttaaataaacaattaaatccttcaattgagcttagcaatattatgactgtgataccacaatttgccaccaatgatggtcaacaaatgcacattggtaatgcagttgcttctggttcagaacatgaaattgaagatcatccttctgaatcagcagctgccacaggcacaagtcagagacaggacaatcttggcaatcttgctttggtgactagcaatccaagtgaaaagatggataataagcttgtttatgtgacacaccgtggtatacggagacgctgtctagattttgaaatggccagtgtgcaaaggaggaacccagctgataattcaaacaccaactcaagtacagcaaaatctgaggagaggaatgttagtaatgaaaagcaactgcttcccacaaaacacagtggggattcacggagatgtgttttgccaggaattggtttgcacttgaatgcacttgcaagcttaaaggattgcaaaaacataaaaattgacacattgtcatctggaaggcaacctaatctgctcagctctccttcatctgtgcaactctctccaagccaagaacatcaactatcattggtacctgcatcagtggaaagagatttggagccattggagaatgaggttcagcctggtgaagattgtacccagtcattggtattggttcagatggctggtgaagatttccagcagaatagtccgaaaaagaaaaggcgcaagttggaaccagctggggaaggggagtcttgcaagcgttgtaattgtaagaaatcaaaatgtttgaagctttattgtgagtgctttgctgctggagtctactgcatagaaccttgtgcatgccgcgattgcttcaataaacctattcatgttgagactgttcttcaaactcgccagcagattgagtctcgtaatccacttgcatttgctcctaaagtcatacgaagttctgattctgtatctgaaattggggatgaccttaacaaaactccagcctcagcacgacacaaaagaggatgtaattgcaagaaatcaagctgcctaaagaaatattgtgaatgctatcagggtggtgttggttgctccgtaagctgtagatgtgaaggatgcaagaacacatatggtagaaaggatggttctgttccttctggattagaagccgaacctgaagaagaaacagaagcatgcgaaaagggtgtggtggaaaatgcttcatggaaaactgaaactcagaataccgaagaccatcccgaccaatctcttgctacaacaccattaccgctttccagatcattgcttccattatccttttcatcaaagggtaagccaccaagatcttttgttactaccatctccagttctggattgtttgtgagccaaaagcttgggaaatcaaatgctccgcggtctcaacatcaacccaaatgtgtaaagcctttgcaaactgttccagatgatgactctcctgtcacctgcatcaaaacttcttctcccaacggcaagaggatctcctctcctaattgtgacgtgggatcatcacctactactcgcagaggtgggaggaagttgatattacaatctatctcttcatttccttctctcacccctcaccattagaatgaagatcttcttcttcggcttaagttagcctacccccacccctcttcccttggttcacgttttcagtttgttgcagttggagctgtatgcttagggtgaatgtacatgattgagtttcgttttactttcgtaatatgtttgttccgttcatttcataatgtacaacttcagttcagttgtataatatctatcttaactgatggttatcatcactcctaagagtacttggagaatgatttgttatcaagtccccattagtcatgttggactattcctttttaatgtgttacatgaagtaaatgtggttggtgctgtggaatttaatgatgctacgttggcagtgaaatcga

SEQ ID NO: 268 - DNA, 1304 bp, Glycine max
  misc_feature (1)..(1304): Glyma.06g148600.1
gaaaaccacgtcacttgtgacacaccaattattttcagtcatggtaggtaatgagatttatcatttatccagtgaaggaaaggaagagagagcaagtgagtgttgcttagtatccaagacaagacagtgataatattggaatttttggaagccaaattaggcttccattctgattctactattttatctgcctagttttagggtactgtttatcatcgttagaatctgaaggtgtgaagagtgaagatggcagaagaaaaagaatcaacgtcaattcctcttagtcaaggggacaatgcatctcgcgacgatcccgaagacccagccaagtctccactaagctcgcccaactcttccactcgcagggcttgctgctttgttctccagagttgggtctctaagaaatttatgactggatgcgtagttctttttccagttgctgttaccttcttcattacatggtggtttattcagtttgttgatggtttctttagtccaatatactccaggctcggcatagatgtgtttggacttggttttgtgacatcgttagcttttgtatttcttattggtgtttttgtttcgtcatggatgggagccactgttttctggattggagagtggttcataaagcgaatgccccttgttaggcatatatactctgcatccaagcagattagtgctgcaatatctccagatcaaaataccactgcctttaaagaggtagcaattatccgtcacccgcgtgttggtgaatatgcgtttggatttattacatcaactgttactctacagaaagataatgaagatgaagagctttgtagtgtttttgtacctacgaaccatctatatattggtgatatatttttggttaattccaaagatattataagaccaaatctttccattcgagaaggcattgaaatcattgtttccggggggatgactatgccacagttgatatctccggtggaaagggctactcgaccgaatgaaagaatttctttgaacagaattggataaaggatttgacctgcggatcatgtgggtgttggaaattattatagtctgaacctccttgtaatggaatatgtatttggatacataaaagtgttgtttaatatttagttctttaatgagagtaatgtaccctgtaacgctgtagttgtaaacttgtaacccagtatacccttgtttttgttctacatgtcctttccacccagcctcagtctgacagagatgaactactatgtaccattagtccaatataatgaatatatgttcaaattggctgcatgttatta

SEQ ID NO: 269 - DNA, 4883 bp, Glycine max
  misc_feature (1)..(4883): Glyma.11g040000.1
acagaccctctttctcatttgtctctctattgccagccagctcgtaaatcaattaattacgaaaaacaagaaaagtaaaagcaaaagagaaagtgatgcacccaaactcacgaccaacaactgttaccataataattcaaccttcgaagattcagtgcattttttcacttcttccccccttatggtggtgatgcactttgtggtaatgcattggaacctctggtgctgcattcttctcggatatcttcatatatcttgtatttctcttagttcaggacatcacttgaataggagtactggcttagaaaactggttgggttattctgggtcacttgtgggatatgattctcaaccctatgattcggcatttgttgaaacatcaacttcgtcattcccgttgaatgagtcagtctcttgtgaggacttggaaggtgtaggatcttttaataccacatgcttgctaagctcaactcattatttaaaatctgatatttacatttatggtgttggaaacctggagatactctctgatgtgtcacttttatgtcccgtggaaggctgcatgataacagtcaatgtatccggcaacattaaacttggtcaaaatgcatctattgttgctggttctgtggttttatctgcagccaatctgacaatggaatacaattcttatatagactcatcatctttaggagggtcaccaccttcccaaactagtggcacacctgttggcgacgatggagctggtggagggcatggtgggcgtggtgcatcttgtttaaaaaataacaagacaaactggggtggtgatgtttatgcttggtctacattgtctgaaccatggagttacgggagcaagggtggtggaaaatctactaaaaagaaatacggagggaatggtggggggcgtgttaagcttctagtgaaagacaatttatatgtaaacggatctattactgcaaaaggaggagatggggggtctgatgggggagggggctctggtggaagtatattggttcatgccgtaaagctgaagggatatggtatcatcaatgctgctggtggaatgggatggggtggaggaggtggaggaagaatatcacttgattgttacagcatacaagaagattttaacattactgttcatggaggtttgagtattggctgtcctgagaattctggagctgctggcacatatttcaatgcacatttactaagtttaaaagttagcaatgacaatgtcacaacagaaactgagactcctttgcttgatttctcaaccagccctttatggtcaaatgtttatgtggaaaataacgcgaaagttttggttccgcttgtgtggtccagagttcaggtaagaggccaaattagtgtatacagtggtggaagcttaatctttgggttgtctgattatccaatttctgagtttgagcttgttgcagaagagcttttattgagtgattctattataaaggtttttggtgcatttagagtttctgttaaaatgttactaatgtgggactcgacaattcaaattgatggtggtgaaagtactgttgtgactgcttctgtacttgaagtgagaaatctggctgttttgaggcaaaattctgtcgttagttcaaatacaaacttggctttatatggtcaaggactactacaattgactggtgacggtgatgcaatcaaaggccagcgactatccttgtctctcttctataatgtaactgttggtccaggttccttacttcaagctcctttagatgatgatgctagcagaggcacggtgacaaaacatctttgcgacacacagagatgcccaatagatttgataactccacctgacgattgtcatgtcaactatacactctccttctcacttcaaatttgccgtgttgaggatcttcttgtaaatggcattatgaagggaagcataattcacattcacagggcaagaactgtgattgttgataccgatggtatgattactgcatccgaattaggttgcactgaaggtattggtaagggaaactttttgaatggagctggtggtggtgctggacatggtggaaaaggagggtctggatatttcaatgggagagagagtattggtggtaatgaatatggaaatgctattcttccatgtgaattaggaagtggaactgagggtcctaatgagtcatatgggcatgttgttggaggcggaatgattgtgatgggatccattcagtggccacttttgagactagacctttatggatccttgagggctgatggtgaaagctttagcaaatcaataaaaagcggtgatggttctttggttgggggtcttggcggaggttctggtggaacagtccttcttttccttcaagaacttaggctcttggagaattcatccttatctgttgttgggggcaatggtggtccagttggtggtggtggtggaggtggaggtcgaattcatttccattggtcaaagattggtatggaggaagaatatgttcctgttgcaagtattactggcaccgtgaataacagtggaggtgctggggacaatgatggccatcatggacaggagggaactataactgggaaagcatgccctaaaggcctttatggaattttctgcgaggaatgtcctattggtacttacaaagatgttgatggttctgatgaacacctttgcattccttgtcctcttgatcttcttccaaatcgtgcaaatttcatatataaacgagggggtgttacaagacggacttgtccatataaatgtatatcagacaaatatcgaatgcctaattgctatacacctctagaggagctcatttatacatttgggggtccctggccattttcagtattgttgtcattcattttattgcttgtggctctgctactaagtactttgagaaacaagttgaccggttctggttcatatcgtagttcaagttcaattgaacaccataatcatcaccgcttcccgtatcttctttctctttctgaggtccgtggagctagagctgaagagactcaaagtcatgtacacagaatgtactttatgggtcctaatacttttagagaaccctggcatcttccttactcacctccccatgctataattgagattgtgtatgaggatgcttttaatagatttattgatgaaatcaactcggttgctgcatatgattggtgggagggatcagtgcacagtatactttcagttgttgcatatccttgtgcttggtcctggaagcattggcgaaggagagtcaaaattagttgccttcaggaatatgtcaagtctgaatatgaccattcttgtctacgttcctgtcgatcacgagctttgtacaaagggatgaaggttggggcaactccggatttaatggtagcatacattgatttttttcttggtggtgatgagaagcgattagacattgtatcaattatacagaagagatttcccatgtgcataatttttggtggggatgggagctacatggcaccttataatcttcacaatgatacactgttgaccaacctccttggtcagcatgtcccggcaactgtttggaatcgcttggtagctggactgaatgctcagttaaggactgtaaggcatggatcaattcgtactgcactaggtcctgttgttgattggataaatagccatgcaaacccccaacttgagtttcatggagttaaaattgagcttggatggttccaagcaacagcttctggttactatcagcttggtatcgtggtagcagttggggattattcccttcttgatttgcaccagtctgatactttggttggcacagatgaatatttgaggaaaaatgtggcacatggaagaaagaatgttaagcagctgcagcatagttggccatacatgagcaattcattatctcttaaaaggataactggaggaattaatggtggcctagtaaatgatgctaccttaaaatcattggactttagaagggactttctattcccactttctctactgttgtgcaatactagacctgttggtcgtcaggacactgtacagttactgattactttgatgcttttagcagatctttctgtcactctcctcatgttgcttcagttctactggattgctcttgcggcttttctttctgttctactaattcttcctctctctctactttctccatttcctgctggtctgaatgcattattcagtaaagaacctagtagagcttcactttctcgagtatatgcactgtggaatgctacttctttatctaatattggagtggcttttatttgttgtctccttcattattcattatcccacttttaccaccctgatgaggcaagcacacgtaatgttaagagggaagatgataaatgctggcttttgcctatcatcctttttctattcaagtctgtacaggcccgttttgtcaattggcacatagcgaatctagaaatggaagattattctctattttgtccggatccagatgctttttgggctcatgaacctggtttatgacagaaaagaaatagaagcattagaaatgtgaacctggatgttaagtttttggtaaatccaacagttcaaaatgatgcttcgtttcggcgtggagcaggagccttgccgtgtgaatatatatattcagagatgtacaggagaatgaagtacagttctgcactttttcgcttctttgtaaaaaaaatctctagagtttcaaggtataatagttacacggaagacacctctttctagtattgtcttttagtttatatattttttgggttcgctttctcatgattaataccactgaagcttcaccacttactcttgtctatgcatttcatcataaattaaagcaaatttt

SEQ ID NO: 270 - DNA, 3643 bp, Glycine max
  misc_feature (1)..(3643): Glyma.13g174900.1
cacacacaaaaaaagcaattacaattacaaatgtctcgtgctgccaactcactcctctgcgtgccaaagtgcactcaaacacaaacactctctctctctgagcctccaatggaaagtaaataaattgaacccacactctccactcccacactcaacgcaacaatttctcttgcaatgacaaacccaaaaaaccaaacaacactctccatcatcatcatagtctacattctcttcttctcactagcaacgacgttggtgtcgtgtctgaaccaagaaggcttatacctctaccagctaaaactctccttagacgacccagactcgaaactctcctcatggaactcacgagacgccactccctgcaactggtacggcgtaacctgcgacgccgcaacaaacaccaccgtaacggagttggacttgtccgacaccaacatcggaggcccattcctctctaacatcttgtgtcgtctcccaaacctcgtttctgtgaacctgttcaacaactccatcaacgaaaccctaccttcagaaatctccctctgtaaaaacctcatccacctcgacctctcccagaatcttctcacgggcccactcccaaacacgctcccgcaacttcttaatctccgctacctcgacctcaccggcaacaacttctccggccccatccctgactcattcggaacattccagaacctggaagttctctccctcgtttcgaatcttctagaaggcacaatcccttcctccttaggtaatgtgagtactctgaagatgctgaacttaagctacaacccttttttccccggtcggatcccgccggagatcggaaacctaacgaacctccaagttctctggctaacgcaatgcaacctcgtcggcgtcattccaacctccctcgggaggttgggaaagctacaggatttggacctcgcgctcaacgacctctacggttccattccgagttcgctcaccgagttaaccagcctgagacagatcgagttgtataacaactcgctctccggggagcttccgaagggaatggggaacctcactaacttgaggctcatcgatgcttccatgaatcacttgaccggaaggattccggaggagctctgttctctgccgctggagagtcttaacctttacgagaatcgcttcgagggcgagttgccggcgagcattgctgattcgccgaatttgtatgaattgaggctcttcggtaaccggcttaccggaaagttaccggagaatctcgggagaaactcgccgctccggtggcttgatgtttcgagcaaccagttctgggggccaattccggcgacgctgtgtgacaagggggcgctagaggagcttctggtgatttacaatcttttctccggggagattccggcgagcctcggcacgtgccagagcttgacacgtgtgaggctcggttttaacagactctccggcgaggttcccgcggggatctgggggctgccgcacgtgtacctgctcgagcttgttgataactcgttttccggttccattgcgaggaccattgctggtgctgcgaacttgtcgctgttgattttgtccaagaacaacttcacgggaacgattcccgatgaggttgggtggttggagaatctcgtcgagttttcagctagtgataataaattcactggttcgcttcctgatagtattgtgaatcttgggcagcttgggattcttgattttcataaaaataagctctctggggagcttccgaaagggattcgttcttggaagaagctcaacgatttgaatctggcgaacaatgagattggtgggaggattcctgatgagattgggggtttgtccgtgctgaattttctggacctttctagaaaccggtttttggggaaagtccctcacgggttgcagaatctgaagctgaatcagctcaatttgtcttataaccgattatccggtgaattacctcctttgttggctaaggatatgtataggtctagttttctagggaatcctgggctgtgtggggatttgaaggggttgtgtgatgggaggggtgaggagaagagtgtgggttatgtttggctgcttcgaacgatttttgttgttgccactttggttttccttgttggtgtggtttggttttactttaggtacaagaatttccaggactcgaagagggctatcgataagtcgaaatggacgttgatgtcgtttcataagctgggttttagtgaagatgagattttgaactgtcttgatgaggataatgtgattggaagcggatcgtccgggaaggtctacaaggttgtgcttagcagtggggaggttgtggctgtgaagaagatatggggaggggttaagaaggaggtggagagtggggatgttgagaagggtggtagggttcaggacaatgcttttgatgctgaggttgaaactttaggtaaaatcaggcataagaacattgttaagctgtggtgttgctgtaccactagggattgcaagctcttggtttatgaatatatgcctaatggaagtcttggtgatttgcttcatagcagtaagggagggttgttggattggccaacaaggtacaagatagctgtggatgctgcagaaggcctctcttatctgcaccatgactgtgttcccgcaattgttcatagagatgtgaaatctaacaatattctgttggacgtggactttggtgcgagggtggctgattttggagtagctaaggcggttgaaaccacgcccaaaggagctaaatccatgtccgtcattgctggctcttgtggctatattgcaccagaatatgcatatacacttagagtgaacgagaagagcgacatatacagtttcggggttgtcatactcgagttggtcactggaaaacgccccgtggaccctgaatttggggagaaagacttggttaagtgggtgtgcacaaccttggaccagaaaggcgtggaccatttaattgatccaaggcttgatacttgtttcaaagaagagatttgcaaggtcttcaacattggactcatgtgcactagtcctcttcctatccaccggccttcaatgagaagagtggtgaagatgttgcaagaggtgggaacagagaaccaaaccaagtctgcaaagaaagatggaaagttatccccttattactatgacgatgcctcggatcatggaagtgttgtttaatgaaagacttgcaagggttggactatttgatgatcctggaagggggagttcgaagcttttcttttactataagagccaacttccctccatgttttccgcgcatgctttgctttacaaaagttgactaaagaaaagagaaattagaaaatagcattttttttggggttgaaaatagaggcttgaggagttgatgttttgccctataaagtatgtcaatatcaagaatcttccctaccaacgttaaattgatgtttgcatcacaaaattgtattcagaaatgatatttccatcgttaaaaagtttattttttggagtagatttaatagaaagacttttagctgacgatggcatgatccaggggagttttaaaattgcaatatcaatgagacaatgacttccacattctgtattatatttttttttaattttttgtttctagaaa

SEQ ID NO: 271 - DNA, 2665 bp, Glycine max
  misc_feature (1)..(2665): Glyma.01g245100.1
tctatagtctactgcactctgacactatcagatatcaatttcagaggcggagcctggaggctggagctgcttcaagtcttcaactatctgaatttctgaactcatccattcgttagcgcagctagaacgaaagtgagatttctccctgccaactcactctctgtcttggttttttctccgatctacatttctcttggtttttctctgagactatggagaccagtgattactttttctctggttaccaagtcattatatttgaaaccggctagtcttttgaaacattcagtgttttctcttctgtctttgttttcattttgcagtttagtttcgggttgaatggcatttagcccttttcagatcttatttcctttcttcttcctagatatccggatgctaaaaagtgaaaacttcattctctgtttttttttttttaatattttctccgtgtttagctcacaataggggtctgaactcttgagcatccttttggaatttcgtagttgagtatatattgtggtagttcaatttgcagtaagatacaacgatgatgtacatatttgggaattgctccaatttaaatcatcatttaaccttggcaaccaaacatgtttgtctaatttgtctgcccagttttgagctgaggtttgagggttgtagatgaaggctcaatttgtaattataaaggctagttaatttgtatttattccttctggtgttcggcaatcaagaaaacaatttgttggccactttgtttattatggatcagtgcatgatctctgcatttccttatgatcttagattgttaaatactcaatgcttgtgcttgataattactgaattttttccttgtctacactattattatgcttcttgattaacattatttgtggtaatttatagactgagtaatggaaagtggagggaactcccttccatcagggtcagatggtgtgaagagaaaggtttcatatttctatgatccagaggttggaaactattattatgggcagggacacccaatgaaaccacacaggattcgaatgacacatgctcttttagcccactatggattgcttcaacacatgcaggttctgaagcctatggctgctaaagatagggacctttgcaagttccatgctgatgattatgtggcctttctgagaggcatcacccctgaaacgcagcaagatcaattgagacagctgaagaggtttaatgttggcgaagactgccctgtatttgatggtctttactctttctgccagacatatgcaggaggttctgttggtggtgctctaaagttgaaccatggagtatgtgatattgcaataaattgggctggtggtctacatcatgcaaagaagtgtgaggcttctgggttttgctatgttaatgacattgtgctggctattttggaacttctcaaaatacatgagcgtgttctgtatgtggacattgatatccaccatggtgatggtgtagaggaggccttttacaccaccgatagggtcatgactgtttcgtttcataagtttggggattactttcctggaacaggtgatattcgtgatattggatatgctaaagggaaatattattcactaaatgttcccttggatgatggaattgatgatgagagctatcagtccttgtttaagccaataatgggaaaggttatggagatttttaggcccggtgctgttgtattacaatgtggtgctgactctttatctggggacaggttaggttgtttcaatctttccataaaaggtcatgcagagtgtgtcagatatatgagatcttttaatgttccccttctattgctcgggggaggtggctatacaataagaaatgtggcacgttgttggtgtttcgagactagcgttgctcttgggattgaactagatgataagatgcctcaacatgaatattatgaatattttggtcctgactatactcttcatgttgctccaagtaacatggaaaacaagaactcccgacaattattggatgaaataagagcaaaacttcttgataatttatctaggcttcaacatgcaccaagtgtcccattccaggaacggccacctgatgcagagcttctagagagagatgaagatcaagatgatagagatgaaagatgggatcccgattctgacagggaggttggcgatgacagcaatcctgttcgcagaagggtgaaaagtgaatgcgttgatgctgaggataaagatacagaaagttatcataaacatctagattgtggaagagattatcttacgcctttcaaggagatttcatgctccaaggtgtcgggggtgtactcaatggcagtggatgaaccatgcatcaaagaggagcaggataatttaaaagagctttctgatcacaggccaagatgaagcaataataagcattactgatcaaccttctccttgactagtgtctgtcgacctgtaaattatagtttcctcctaaagcagtctggcatgcattcatctgacgtctgtagtgtttcaaatttttgctttatctggaaactgaagagatatggtgcaagcttgccttggcttttgatgtttcatattactgcaagatgaatgtagtagttattttttctgtatgtttcactatggtagcagactttgtcaagggagcagct

SEQ ID NO: 272 - DNA, 984 bp, Glycine max
  misc_feature (1)..(984): Glyma.02g098100.1
ttcaatcctaattttccattttccattttccattttttgtcttgctacttttcatttatttgttatatactgtgaggaagaacatcaaaacccaaacgaaaagaaaaaataaataaatcaaagaacacaaacaaagaagaagcgcaaaatgaagagtgcgatttgtgggagaatcctctctcccaaccacgtcttcaaaccaggggacacacattcaatttgtaaaggaccatactccaatctttgtgtacccatggctgtattggcaacaggacctggtaaaggaggcggggtgctggaaaagcccgttattgaaaaagtcacccctggccgtgagtctgaatttgatttgaagaaatcacggaaatcagcaccaccgtatcgtgtaatattgcacaacgacaactttaataaacgggaatacgttgtccaagtactgatgaaggtcatccctggaatgacccttgacaatgcagttaatatcatgcaagaagcacactacaatggattgtcagttgtgatcatctgtgaccaagctgatgctgaagatcattgcacgcagctaagaggcaatgggttgctcagttcaattgaacctgcaagtggaggctgctgatggcaagtttcactttaaatctcactggcttttatgctattgaaaggtgagatggaactattagcaggtgtacataagttccccctcttgaaggcttagaaaccaaaaaagaaaatatatcttgtgtaaaaacttggccttatgtgaacgaacctatgattaagacatgtgatagttgtgattttgaataaagaagcgcacaacatattaaagctaatagctgatgaaatgattgtggtatgtatgtggaaaacatagagattagatcaacataataccacagcactgtcatgttacttgataacaataggatctaaatctacatgtggaaagcatataaaatttagatcctctcatttatttattta

SEQ ID NO: 273 - DNA, 2932 bp, Glycine max
  misc_feature (1)..(2932): Glyma.07g190600.1
taattctttaataaaattaaaggatataaaaatatatctagaattaattccctaaatacacccaggtcgtgaaaggcaatttatagtgaggttgcagaaggaagtttggccgcaatcactttctgtcattcttctctcctctcttctattccattccgtcatttcactatttaatctcccatttctcgttcctttaccaccctcacttcactgcttagggttttcttgcactcacgccattctttctttgctgaatcactctgcattttgaactttctgagaagctcagtgtttctgttagacatggaaaccgacgaatcctctcgcgtgattccctttcagcttcaattcgataaacccctcgcttctcagatcaaaattgcggagtggaatcccgagaaggacttgctcgccatggtgactgacgattctaagatcttgctccatcgtttcaattggcaacgcttgtggaccattactccaggaagatgcataacatctttgtgttggcgtcctgatggaaaagcaattgctgttgggcttgatgacgggacattgtcactgcatgatgttgagaatggaaagctattaagaagcttaaaatcacattgcgctgccattatatgtctcaactgggaggaggagagtcagctaattacagatgactttggtcacacttccaaatatgaagatagaacctctcgtttctttcctcctgctccaagagttcctcggatgcctggattggtatctggggataatggcttcatggatgatagcgaagattcatttcaggagctgtcaaattcttctcaccaacgattcaacatcctatgcagtgcagataaagatggaaacatttgttttagtatatttggcatcttccctatagggaaagttaacatacacaacctcacttttcctactttctgtgatggttcagaaatgagtaatggagtttcaaatgctttgatacacaaggttgctttatcaaaagatctttgtcgtttgatagtcacgtgctcaggagaccttgttaaagttggtgatgacttgggagaaattcaaatggttgggaacaatgagcatggtctgcattgcttagcactgaacacagctatattttggaataggaaaaatgagcttcaccaggtagctcaacaagcttctaacatagaggatttgactgaggttgttcggacatcattatcagttatgtgtaggcaatggtctgatgccatgaacacatttcaggagaagttcagatctttgtctactctgataataaatcatggacttgattcgtcacctcaagaggagtttctgagccttttgggtggtgcaaggactagcccaccagttcatcaatttctcgttaacactcttggagaagtgggtgttaagcgtatttcaaaggttctctccggtgcaggcaaagaacttcaacgtattgtcttggaccacctccagcctgctgtagaagtgattggattcagaataggagaactaagagggctttcaagatggcgtgcacgctatcacggcattggcttggatgaatcacttattaacaatgcaacagaaaaggctggtatgctacttgtacaagttgaacgatttatgagggttctttcatctgttgtgcagcagtactcaaacttcttcaactggctattgaagtgtataaaattactcatgtcagaaccaagtgaccagcttctaccatataacagtgaacttgttattgtattcctgaagtttctctatgaacaagatccagttaaacaattgctggaagtatcagaaacagaatatgaagttgaaattgatttggaaacaatgcagagagttagagaattagttcagtttgggggatttgctgacactgaatatctaaggagaacattggttaaagaatttcagctgatggaattaagctttaaagaggcttttgaaatgccttttaccacaatatcaagaaagatactttgtgaggatatactacctctgtttcctcttccatctttgccaaaatcatcttcttccatgtggattcccacttcagtatcatattatgaggatccctctagagcttctgtgccaccttactcttgtcaaaaccagtttattgattacatatctttccaagtacctgatgagtgtttctcagatattgtaaattgtatatgcatagtcagaggattcatgcatgactcagactgtctaaagaaggggtatagttctttggaagctgtactgttatgtgttcctgttgattatcaatgtgtggatctgtctttgtacaaggatagtcaaatcgtcctgttactaaacaaagctactaatacatcagaaagtgctggagatggttgtatgatgattctgcaagtaagtgatctaccatatgtctctatgtcaagatctgcttgtatagatgtttggaggttaccagaactaaaggattctgtcgcttacctgaatattggggatgagaaatctcgcaccattcgtcattctgtaattgctcccttggcagttagtgcatcaagaggcgtggcttgtgtatttgctgcaacaaagcgtgctctagtctacattttggaggaagatgaagatgaggtctcggatgtagaatagtttgctatttaatttatttttcattttttgcttttgttttggctgtggttgaggggttgtaatcatttgccattttcataatggtccttgaaaaacattgttgtagaatgtccatatcccttattagtgttcacttgaacacgtaattaatttaattatttttcctaagatagaagtaatcagttaagcccaaaaaagtaaaaaagatcaaacagagtaaaagaccgaaagtactggagtttagtacccattaataataatttgctaattgtttgaggtaatactttcattttgc

SEQ ID NO: 274 - DNA, 4010 bp, Glycine max
  misc_feature (1)..(4010): Glyma.12g052800.1
ggggagaagagaagaagggagaacaacaacggaaagggtttttggttttggactctgaaactcaaagtgatgcgtttcatcgttccttcggccaaaccctaactaacctcgtcgtgcattcattccccgggatcaggtgttgctgactgagatctgctgatcatgtgaattttttttaattgccaaatttagcattgcttcatgtatccaaaacggtcaggccaagatggccctgattccagacaggtgcgctcaagtgataggatcaagacaaggccaaacgtttatggccggccatatttgtattacaaccaaaaccttaggcgcaccaggaaaagcaagatcaagacaaggacggcagcttcacagattgctaagatgttgcgtccggggaatcgaaaatcaaaagattctaatactaattctggctctgccaaccttcgacgttcaacaaggaaaagaaggcttaatgtaaatcttgaagattttacggacagctctggagctgaagacgaagacttaatgagaccacctacatatccatcattgagaaaccggatgaaaaatagtgacagacgggatggtttgatgtctaataagcgcaaaagagtggcggagactaaacaaacacctcgacgtgaagggctgcgtcctcgccgttcaaagggtgctgcaatagaacgattaattttagaatcagatgatgagcaagacctttcagaagaaaaggttgatcaggatgaaacagaaaatggaaatgatgttgaggaaaatgatgcagatgatggccaaaaggagattgagggggatgctgagggggaagatgaaggtgaggacgaaggtgatgaagatggggatgatgaagagggtgaagaagagcaggatggaagaaggcgctatgatcttcgaaatcgttcagatgtccgcaggttctctatggaggaagggaaggcccagccaagatctcctcgaagagtgttacatcaaggtatgggaactaaggtcagcagggatgtaaggaaaggtggatcacgagttcataagcgtcatcgtttagcgaggcctgaagattctgatgactcccttcttgtggatgagctggaccaaggcccagctattccatgggggcgaggtggcaacagatctggtcctccttggctatttgggggcttagacatgcatggaacaacagctttcggattaaatcttgctgcatcaggttggggtcatcagggtgatgcggtggctactctaacttcggggattcaaactgctggaccaagctctaagggaggggcagatatccaacccttacaggttgatgatagtgttagttttgatgatataggtgggctctccgaatacattgatgctcttaaggaaatggttttctttccattattgtatccagatttttttgcaagttaccacataactccacctaggggggtattgttatgtgggccccctggcacagggaaaacattaattgcaagagctttggcttgtgctgcttctaaagctggccagaaggttagcttttatatgcgtaaaggagcagatgtgttaagcaagtgggttggtgaggctgaaagacaattgaaactactctttgaggaagcacaaaggaatcaaccttctattatcttctttgatgaaatagatggacttgcacctgtgaggtctagtaagcaagaacaaattcacaattccattgtgtccactttgcttgctttgatggatggtcttgactctcgtgggcaagttgttttaattggagctaccaacaggattgatgctattgatggagccttacgacgccctggtagatttgaccgtgagtttaactttcccttgcctggttgtgaggcacgtgccgagatattagacattcacactcgtaagtggaagcatcctcctccaaatgagctgaaaaaggaacttgcagctagttgtgtaggttactgtggtgctgacctgaaggctctttgtactgaagctgccatccgtgcattccgtcaaaaatatccacaggtttatactagtgatgacaaatttgtcattgatgttgattctgtcaaggtagaaaagactcattttattgaagccatgtctactattactcctgctgctcataggggagctatcgtgcactctaggccattgtctctagtagttcaaccatgtcttcagagacatttagagaaagccatgagtattatatctgatattttccctccagcttcaattacatcagagttgaccaaactttcgatgctctcctacgggtctgcaattccacttgtgtatcggcctaggcttatgctttgtggtggtgaaggtacagggctggatcatcttggccctgcggttttacatgagctggaaaaatttccagtacattcattgggacttccatctcttctgtcagatcctagtgcaaagacaccagaggaggcattggtacatatatttggtgaagctagaagaacaacaccatcaattctctacttaccacaatttgatgtttggtgggagactgctcatgaacagctcagggctgttctcctgactttgctagaagaattaccatctgacttgcctatcttactgcttggtacatcctcagttacacttgctgaagttgaggaagtgcccacttccattttccctcatcgctcaatttataaagtgaatatgccatgtgccaaagataggactttgtttttcaatcttttgatagaagctgctatgtcaatattgttggagggaatcaacaagaaatctcaggatgcaggatgcctccctgaacttcccaaggctccaaaattggctagtggtccaaaagtgtctgagctaaaagcaaaggtggaagctgagcaacatgcacttcgtagattgcgaatgtgccttagagatgtttgcaaccggattctgtatgacaaacgatttaatgccttccattatccagtgacagacgaagatgcaccaaattatcgttcaattatacagaacccaatggacatggctaccattctgcagcatgttgataatggtcactatattacaagtgctgcattcctgcaggacatcaatctcattgtttccaatgcgaaggcttacaatggagaggattacaatggtgctaggattgttagtagagcttgtgagctccgtgatgcggtgcatggaatgctctcacagatggatccagcactggttgcatattgcgacaagattgctagccaaggtggcccagttcagttgtctgatgaattaggggattctactttccctgctactcctgttgtgcagctgggtcagagtactagaatgagtgctcgacttcgtcatgtccaaccagaggttaatatggatcagagttatgaagtattgaagcgaactaagaagattgccgaagtgcatgcagcagaagaaaagtcacaacaagattcggtgccatcaaagtcttccctggagcagcaggcaaatgacacaaattctgaaaggctggaacatgtgtcaattgaaggagatttgcatggaacttttacaaataaccttgctgatggcaacagtcctgatgatgtcacagtgctagacggtgaatttttaggagaagtagagtctgtcaagcagctttttgtgaagcgtagtgaaaattacagcattccacaacttgaaaggctttacacgagaattatgaagggcgtgtttgaaaccaaaaataaaggagtgagtggggatcttaagtcttcggttttgaagtttctgttgaattttgtagaggatgatgcaaatttctaattcctcggtttttccttctcccccaatgatttagaaaaaggaaagatttctactgtaaagtcgggattttttaaatttaaattaaatgtcatttgattgagtacaagagttccctttcatctcccttcccctgagatccacaattgtccaaagcgatttatagtagtgtgtaatcatttattctgtctctattctgtattatt

SEQ ID NO: 275 - DNA, 2746 bp, Glycine max
  misc_feature (1)..(2746): Glyma.16g082400.1
aataataaagtgaatctttcatcctcttcgaaaatcacttgttagttaagctatgcattaaccaaccaatcaaaatcacccttaggatacactattgttcagtcgacactgattcgctaagaagaagcagaagcagaagaactgcacattccagtgcagcagatcgaaacttttcttcccttccctttcaccatggccgaatttctggatctcgaatcccaagacggcgtgcgaatgccgtggaacgtgatccctggcacgaagcaggacgcccaaaacgccgtcgtccccgtctccgccgtctacactcccataaagcacttcacctcgatgccgctcctcaactactcccctctccggtgccgcacttgccgctccgtcctcaaccccttctgcatcgtcgacttcgccgccaagatctggatctgccccttctgcttccagcgcaaccacttcccccctcactacgcatccatctccgacgactccctccccgccgagctcttccctcagtacaccaccgtcgaatacaactccgacgccgtgggccccaccaataccccctccgtgcccccagtcttcctcttcgtcgtcgacacgtgcgtcatcgaagaggagatcgggttcctgcgctcggcgttagcccaggccgtggagcttttgcctgagaactcgctcgttggactcattaccttcgggatgtttgctcatgttcacgaattagggttcggtgcggtgccgaagacttacgttttcaagggatctaaggatgttaccaaggaccagttgctcgagcagatgagtttttttgcgaagaagccgcgcccggcggtcggcgtggtcgctggcgcgagggacgggctctctacggagagtatttcgcggttcctcgtgccggcgtcggagtgcgagttcactctcaattcggtattggaggagctgcagaaggatccttgggcggtgccggcggatcagcgggctgctcggtgcaccagcacggcactgagtattgcggcgagtttgttgggggcatgtgtccctggctctgctgcaagaataatggcatttattggaggaccagctactgaaggacctgctcctattgtatccaaacaactttctgaaccaattcgctctcacaaggatctggataaagattctgtgccacattaccataactgtgtgaaattctatgatggactttcgaagcagcttgttcatcaaggccatgtactagatctttttgcttgtgctcttgatcaggttggaattgctgaacttaaaacagctgttgaaagaaccggaggtcttgttgtacttgctgaaagttttggccattcagtgttcaaggattcactaaagcgtgttttccaatcgggtgattatgatttgggtctatcttcaaatggaatatttgagataaactgctctaaggacttgaaagtccaaggtattattggcccttgtgcatctcttgaaaagaaaggcccattatgctcagatgttgttattggtcaagggggtacaagtgcatggaagatgtgtggccttgacaaatccacatcattgtgtctatttttcgacgttgtgaggaaggaaactcctgatgcaacaatgcagtccacaagcaatcaattttacttccaatttttgacgtattatcagaataacagtgggcaaatgagattacgggttacgaccctttcacgtagatgggttgctggaccagaaagtatacaggacttgattgctggatttgaccaagaagcagctgctatagtcatggcacgccaagtctcttttaaaatggaaacagaggctgaattcgatcctatcagatggttggacaaggcattgataaatttgtgttctcggtttggggaatttcaaaaagacactccatcttctttcagtttgtctcccaggttgtcaatattccctcaatttatgtttcatttacgacgctctcaatttgttcaggtctttaacaacagcccagatgagactgcttactttagaatgatactgaaccgtgaaaatgttacaaattctgttgtcatggttcagccttcgttgatttgttattcattccatgctggtcctgaaccagctcttcttgatgttgcggccattgcggcagataagatcctgcttttggattcatttttcactgttgtcatttttcatggttcaaccattgctcagtggcgtaaggctggatatcataatgaaccggaacatcaggcatttgctcaattgctactagctcctcatgatgattcagatttaataataaaggagagatttcctgtgcctcgcctggttgtttgtgatcagcatggctctcaggctcgatttctactagcaaagttaaacccttctgctacttataacactgaatcttataatcctggaggggatattatctttaccgatgatgttagctttgaggtcttcctggatcacttacagagattagtagttcaataaaattacagttttaccttggactttttatgtaaaattttccttcgattgctgcttgtacattaccttcattttagtatgctgttataatttccaattttgtgcaaaatgttgtaattatttggaatcatgcattctcaaatcgatgacatgagtattaaatctattgtctagttttgtgacaggtggaatattgtttggtggttgcacagttttataaatactattgattataaaatcacgagtcattaagtaagac

SEQ ID NO: 276 - DNA, 2164 bp, Glycine max
  misc_feature (1)..(2164): Glyma.07g177100.1
cagttaaaccacaacaatgctcaatctaaagttttttctcttccaaacaaacactgtgatggccatttcctatcctgcagaatgaatactcaattttgcagaacaccaccccatcacgtgcatgcacccatcatccccacttcccacttcccttccttgtacactgtctcaccctcccacccacgtttcttctttcatgccaatttctcagcttctcccactcccatcttggaagaagaaccttcttccaacacccccatcatccatgttgtggatgttaactttgatgttcagcagcaatattccaagccagaacctgagaacttgaacgagtttttatgtgggttgttcgaggatccaaagaccaaggagcttgcttttgactactaccaaaggttgaaagagaggccagagtttagacccgagaagccaacactgaagcatgtgatcaggtacttggtgagtttgaagagttgggattccattttgtcggtttcagatgactttaaggtttaccatgtgttgcctgatagggctacttgctctaggttggttaagttttgcattgagcataggaaattcagggttgctgaggccctgcttgatgtttttaagtctgatagtaaggttgctttcatggcttttagttctgccatgagaagttacaacaagctgcatatgtttaggaacactgttttggtctttgaaagaattaggtcgagtaatgttgttctggattcgagaggttatttacacattatggaagcttactctaaacttaatgagtgtgagaaagtggttcagttgtttcgtgaatttgagagtaggaagttaagaggtccaacatgtttagctcagatatatgagattctgtgtgagtcattagcgaggtgtggaagagcttctgaagcacttgattactttagagagatgactaagaaagggatttctgaatactcaatttactctaaattgatatactcttttgcgagtttgggcgaggttgatgtggctgaggaacttgtaagagaagctaaaggaaaaacgacgataaaggaccctgaggtctatttaaagcttgtgcatatgtatattgaagagggtttgttggagaagactttagaagttgtcaaggaaatggaggatgcagatgtcaaggtttctgattgtatactatgtactgttgtcaatggcttcagcaagaaaagagggttttcagccgcagttaaggtttttgaggagctgatttccaagggcaatgaaccgggtcaagtcacctatgcttcagttataaatgcatattggcgtcttgggcaatatagcaaagcagaagaggtgtttttagagatggagcaaaaggggtttgataaatgtgtttatgcttattcaaccatgattgtgatgtatggaagaacggggagggtgagaagcgcgatgaagttggtggccaagatgaaagaaagagggtgcaaaccaaatgtgtggatctacaactccttgatagacatgcatgggagggacaagaatttgaagcaacttgagaagctgtggaaagaaatgaagagacgaagggtagcaccggataaggtgagttacactagcattattggtgcttatagtaaagcaggagagtttgaaacctgtgtgaagcttttcaatgagtataggatgaatggggggcttattgatagggccctggcaggcataatggttggtgtgttctctaaagtcggtcaggttgatgaattggtgaaactcttacaggacatgaaaacagaaggaacaagactagatcagaggctgtaccaatctgcttggaatgctttcaaagatgctgggttgcaacttcaggcaaggtggatgaaagagagcttccttgtgacatagtgttctttcaattttacaaattgtggcaaaatctgaagctgaaatattcgaaaccggtgagtaatttgatgcttgttgctttttcaggcacttgaggtgtacaaaaagatctatcataatatatatcatgtataggtttttgaaatgaaaggctctggcttgtacattttagctttatgccgtttctattgtatgcttccaaaaccaaattgtactcaagaaacgtctttcaattatgacttccataatcaaagtaaaaggccattagtagcagcac

SEQ ID NO: 277 - DNA, 1466 bp, Glycine max
  misc_feature (1)..(1466): Glyma.06g311400.1
tcgtacggacgaatactccgctgaatcaatagtaatagaacctcgttggtttctgagacagccagagccaccttcggatctgagagatcgccacgcacgcacgcacgcttcctttgattttgtcttccgcttcgtcatttcctattctcagcttccaattctcctcctccttcttctaattctacttcttttcgagggttttcgttcctctgtgcctgattgatccctaattcgataccatgcggaagaagctcgatacccgtttccccgctgctcggataaagaagataatgcaagcagatgaggatgtcggaaagatagcgttggcagttcctgttttagtttctaaagctctggagttatttttgcaagatctttgtgaccgcacttatgaagtaacccttcagagaggagcaaagaccatgaattcattgcatttgaaacattgtgtacaaagttatagtgtttttgactttctaagagacattgtcagcagagttcctgactatgggcatggccatggccatggccattcagaggctggagctgatgatcgtgcacttccaaagagaaggaaagctgttggtgacgacggcaatgacagtgatgaagaggctaagaggagtaagatgcgtgagctgggccacactggcactcctggtaggggaagaggccgaggtagaggaagaggccgtggccgaggggctcgaactattgaaagagatatctgtcatcagcaggttgaatccgagccttgcacctctattctgcaaagtagcaatgatattcctaacactagtgtgccaatagataatggtccacaatccaaggagttaccaaaggagaactttgtgatttctgaggaaagtactcaatctttccgcaacattgatctgaatgctaacttaaatgaaaacgaagacaaaaatgctggcacagctgttccggcttcattgcctgagcccacttccatggacactgccatggagattaaacatgaagaaattccaggctggtccctatctgatgtggacaagatgggcattgacactatgcagcttgcaaacctaggtagtcgactagaagaggacgaagaagattatgacgaggaagggtaaataacatacactttgggggattaactctgctggaagctcatggtaacagtagcagagtaagtacgtactagtgctatgatgactagcctctagtactgtatgtctcccatgcaaagtatctgataaccctctctcttctttgtctattctggtttgtatctgttctcatgtagctagcagatgtagcttttctcttaatagaaatgttagcctcatgcacttttagatttaaatggatgttgttagttgacaaccaccttgctagttcaggatcaaactcttcgtaaagcttggttattagctgaattaatcatgttgggttattcaagatatttgttgcctgataaa

SEQ ID NO: 278 - DNA, 1371 bp, Glycine max
  misc_feature (1)..(1371): Glyma.13g253600.1
aaataaaaacccaacacagacacaaattgtcctctctttttttcaattgtcccgatggtgtttagttagtttgtattaatatttaattttattaatatttaattttatcattcaatgtaaaattgtgtgatttttaagtgacgggaacaactgaaaaaagaataagccagatccagacagacactgccagtgcgagaagcctatcagcaaacagagtcttcttcttttctttttcttttttctctacacacagtgaaggaaggaagagagtatcatccatggcggccaccagagcagtaaccattgccagcaactccacatgctctctgcttgcaaagaaaacctttgtgggtggcactgctctttccctcaacaacctcaaattttgtcgtactaggaggtcttacacctgcagagccatctacaatcccctggttgtcgtcaaggaagaaggccaacccgaaacctttgattatagagttttctttgttgacaaatctggcaagaaggtttctccctggcatgatattcccttgcggttaggtgatgatatctttaacttcattgtcgagattcctaaagaatccagtgcaaagatggaggttgccactgatgagtctttcactcccataaaacaagatacaaaaaaggggaagctccgatattatccctataatatacactggaactatggcttacttccacaaacatgggaagatccatcttttgcaaactctgaagttgaaggagcattgggagataatgatccagttgatgtggttgagattggtgaaagacagaggaaaataggtgaggttctcaaggtcaaacccttgggtgcattagccatgattgatgaaggagaacttgattggaaaatagttgcaatttcattagatgatccgaaggcgccatttgtaaatgatgttgatgatgttgagaagcattttccaggaactctaactgcaattagggactggtttagagactacaagatacctgatggaaaacctgctaataaatttggacttggcaacaaggcagcaaataaggattatgcgcttaaggtcatcacagagaccaatgagtcctggaataaacttatcaagagatcaattcctgcaggagagttgtcacttgtgtagagatgtattgggggaatgtctattgttcatgccattgcttgcattttctacaattctatttatgaagtagcaaatttttctattgagcttcccagttataactttgacatcaatgtccatttggccagccattagttcaataaatccatcttgcttatgtattctacattttattttgtcttttttcaggtttatttctaatgaagtaactccagatgattttagg

SEQ ID NO: 279 - DNA, 2524 bp, Glycine max
  misc_feature (1)..(2524): Glyma.07g077400.1
gagagggaggagcagatatttatagtggggtttagcatcaccatcaccatcaccgtacaagttcaaaacacaagttgcagaaaaattcaacctatccacactccttattattccttccttaaccaataatcagcttcagcacccaatacttaacacttggtctcccatttaactcaaactctacttattcttcatcacttcaacacttccaacagtaaaaaccactctctctctctttctcactttgtccacgtgaagtgaaagaagaagaaactcataaaccatggcaaacacaaataacttcttaacccaacttcacaattgcacccgcaaaaaacctaacaccctattcaccaacctctaccttctcacctttgctacctttctttgtacccttttctacttcctcggcctctggcgccactaccccaccaccaccgccgctgccatcgccgccgtcgcagaatcctcctccctatgcttccaccccaacaccaccgtcacaacccaatcatccaccagtctcgacttcgccgcccaccacctcctcccggaccttcctcccacggtggcgcgtgggccctatctccctccttgcgcgtcccccttctccgagcacaccccctgcgaggaccaacaacgatccctttcattcccgagacacagactcgcgtaccgggagcggcactgtccagcaccggaggagcgtctccggtgccggattccagcgccgtacggataccggcagccgctgcggtggccggcgagccgcgacgccgcgtggtacgcgaacgcgccgcacaaggaattaaccgtagagaaaaaaggccagaactgggtccggttcgatgggaaccggttcaggttccccggcggcgggaccatgtttccccgtggcgccgaccaatacatcaacgacattgggaagcttattaatctcagagatgggtctgtccgaaccgccattgacaccggttgtggggttgcaagctttggagcttatcttctatcccgtgacattttaacaatgtcatttgcaccaagagatactcatatatcccaggttcaatttgctcttgaacgaggtattcctgcattgattggaattcttgccacaatcaggcttccatacccttcaagggcctttgacatggctcattgctctcgttgcctcattccttggggccagtatgatggagtatacatgactgaaattgatcgagtgctacgtccaggggggtattggattctatcagggccaccaataaactatgagaaacactggagaggttgggaaaggactcatgaaagtctcaaagaagaacaggatggtattgaggatgtagctaagagtctatgctggaaaaagttggtgcaaaaggacgaccttgcagtatggcagaagccaaccaatcatgcacattgcaaactcaagcgaaagatcttcaagagtggtagtagacccttatgtggtgaggcacaggatccagacacagcatggtacactaagctggatacatgcttgaccccacttcctgaggtaaagaacatcaaagaagttagtggcggtgggggattggctaactggcctaatagactaacttcaattcccccaaggattagaagtgagagtttggaaggaataacggctgagatgttcacagaaaataccaagttatggaaaaagagattggcatactacaagaaactggatcatcaactagcggagcgtgggagatacagaaatctgcttgatatgaatgcttacttgggaggctttgcagctgcactagttgatgatcctgtgtgggtcatgaacattgtccctgttgaggctgaaatcaacacccttggtgttgtgtatgaacgtggattgattggaacctatcagaactggtgtgaagccatgtccacttacccgcgaacttatgacttcatacatggtgattcggtttttagcctctaccagaacagatgtgatatggtggacattcttctcgagatggaccggattttgcggccacaaggcagtgtcattttgagagatgatgtggatgtgttgacgaaggtgaagatcattgcagatgaaatgcaatgggatgccagaattacagaccatgaagaagggccttatgagagacagaagattctggtagcagtaaaagagtactggacatccccaccaccagagagaaaccaacacagctagcacttagtttgatatgcttcaggattctgtttttcttttattgtgaattttctcatgagtcaattctttcaaactctcattcttgttagtggtaaaagtgaaaaattctttgtaaaattatgggccctggaatatttgaggcagcttttcatcaaattttaatatagtgggaaagcatgtaaattgattggaacaggaactggtaattagtaaaaaccaagttgtctcaatatgggccgtattgccataacatgcctcttatctccttaaatagaatggacatctgacattatttaatgtttgattacttatgtt

SEQ ID NO: 280 - DNA, 2035 bp, Glycine max
  misc_feature (1)..(2035): Glyma.15g098100.1
catcttcaaaatctctcctttctttgaatcccattattttctgcgtcaattttgctgaaaaccttaagtgggtatcctgaaaacactagattttcgattcgtttggtaagcggatttttaggtttgattattacgtttttctgttcttgttggatatggaggtttcggtgattggaagctctcaagcgaatctgggagcgtcggaattggcatctagggaagttggattttgcaatcttaagaacaatttaagggctttgaatgatagagttagttttggtaggaataatatacggtgggagaaggctgggattagcttcactttgagggctcttcagactgaacccgttagagaggagaagaagccttctgggattggaacaagatccaaaatggcaaatggtttaagattatttgtggggcttcccctagatgcagtttcttatgcctgcaattcaataaaccatgctagagcaatttcagctggcctaaaagctttgaagctcttaggagttgaaggtgttgagctccctatttggtggggaattgttgagaaagatgccatgggacaatatgactggtcaggctatcttgctattgctgagatggtccagaaagtgggtctcaagcttcatgtgtctctttgctttcatgggtctaagaaaccaaatatccccctacctaaatgggtatctcagattggtgaatctcaacccagtattttcttcacagataggtcaggacagcattataaagaatgcctgtccatggcagttgataatcttcctgttcttgatgggaagactccagtccaagtgtaccagagtttctgtgagagcttcaagtcttcattctctccattcatgggctctacaatcacgagcatttccatgggtttaggaccagatggtgagctacgttatccatctcaccactggctgccgagtaatggtaaaactcaaggtgctggggaattccagtgttatgaccaaaacatgctcagctttctcaagcaacatgctgaagcatctggaaatcctctgtgggggcttggtggtcctcatgatgcacctatctatgaccagcccccatacaatggcttcttcaatgatggggcttcttgggagtctacttatggggacttcttcctctcttggtattccaatcagctcatagctcatggagactgcctcctttcattagcatcttcaacttttggtgactctggagtggcgatctatggaaaaatccctcttatgcactcttggtatggaactcgatcccatccttcagagctaacagcagggttctataacacagttaacagggatggctatggaccagttgcacagatgtttgctcggaactcgtgcaaaattatattacctggcatggacctttcggacgcgaaccaaccaaaggaaaaccattctagccctgagttgctacttgcacaaattatggaagcttgcaaaaagcatgaggttcaggtttcaggtcaaaattcgtctgaatctggtgttccaggggggtttgaacaaattaagaagaatttatctggagataatgtattggacttgttcacatatcatagaatgggagcatcattcttctctccagagcattttcctttgttcactgagtttgtccggagccttaagcaaccggaactgcattcagatgatctacctgctgaggaggaagtaggtgctgaatccgccgtggttatgagccgtgattcaactgtgagcatgcaagcagcctaatggttgtaaatttgtaatctatgataatcatgtatataacaattagttattattatactacccttgcatcagtgcatgggatgagattgaggacaggttattttgtaagcataatatgaggatcccttttccttgtttattctaagcagagaccttatagttattccttataatgtagccaggtgggtggcagattgcctttttgtcatttgtgctcatgtggtatacatttctggtcaatattacttagcttaataagcaccagtttt

SEQ ID NO: 281 - DNA, 684 bp, Glycine max
  misc_feature (1)..(684): Glyma.13g336200.1
atgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaggttagtgctgaaatgcttgttaatttgggaattccttgggttattattggtcactctgaacggaggcagcttttgaatgaatcaaatgagtttgtgggagataaagttgcctatgcacttcaacaaggtctgaaagttatagcatgcattggggaaactcttgaacagcgtgaagctggtacaacaacggctgttgttgctgagcaaacaaaagcaattgcagctaaaatatcaaattgggacaatgtcgttttggcctatgagccagtttgggccattggaacaggaaaggttgcaactcctgctcaggctcaagaggttcatgctgatttaaggaaatgggttcatgacaatgtgagtgctgaagttgctgcatctgtaagaattatctatggaggctctgcggaatttgtggacatcataaacgctgctactgtgaagaagaattga

SEQ ID NO: 282 - DNA, 1765 bp, Glycine max
  misc_feature (1)..(1765): Glyma.15g219300.1
ggtcattcattactcattggtgggtctccaccgtcaactcttcaatatttatccaactatgtctataccacattatctccttgccattaccataaagtctactcttcaatacatcataattgtgttagccaagaaatgaagaaatcaaagcattgaatgaagctgcgatgggaaactcgcatgctaaaaagcgtgacactcaattttccagaaacgttgttgaagggagagttccctctccgaaaaacaaaaccttgtcgccgtcaccgtcgctagaaccaccactaccacgagaaccaccaccagcagcagctatgtctttgaataagggttcggggaaactgtctgccaaagagaaatatgctctgattcccgataacttcaccaccctagaacaggttacaattgccttgaggaaggaaggtttagaatcatcaaatcttgtccttggaattgatttcacaaaaagcaatgaatggactggaagtgtctcattcaacaatagaagcctgcatgctattggaagtacacctaacccctatgagaaagccatctctattattggcaagactctggctccttttgatgatgacaacttgattccttgttttggctttggtgatgccaccactcatgatcaagaagtgtttagctttcacagtgataattcaccttgccatggttttgaggaagttttagcttgctatcaaaaaattgttccaaacttgagactgtcaggaccaacatcttatgctccagtgattgaggccgcaatagatatagttgagaaaagccatggccaattccatgtgttagttattgttgcagatggccaggtaacaacaagtgctgcgtctgaggatggagaactcagtccacaagaagcaaggacaatcaaagcaatagctgatgcaagttcatatcccctttctattattctggttggagttggtgatggaccttgggaagacatgaagaagtttgatgacaagataccagctcgcgactttgacaattttcagtttgttaacttcactgacataatggctaagaaatcaagcccctcagaaaaagaagctgcttttgctctggctgctctaatggagatacccttccaatataaagcagccactgaacttggactacttggtcgtgcaacaggaagatcaaataaaatagttccaagacctcctccagcaccatattcccagcttgtgccaccagctcgtgttctgagcaatacgccaactttcatggatgatgaaagaaatcaaatggcatgtgctatttgtctaacaaataaaaaagatttggcctttggatgtggtcacatgacttgtagagactgtggatctaggttaaccgattgtccgatatgtcgtcagaggatcaccaatcgtctcagggtgttttctagctgattgaagaatggaaaaatggctaagaagataagtgtcttctatacatttgttgttgtggctttcaagagtgcccaagaacaaccgtgttattgcatagaaaaggtggcttcgcaatgtagggatgatttaggagtcgagaaaattgtgcatgtatttgttagtagttgttcaattaggccatgtcccatgtgtctgaatttgaataattgtattttaactaatgcacattgtacatattatttatatgtacctatgttaaaactttatgtatggttagagattgtgcaaaatatccattggaatcccgtacttgctattatattctacaagttaaggactaagag

SEQ ID NO: 283 - DNA, 1392 bp, Glycine max
  misc_feature (1)..(1392): Glyma.09g024400.1
cggtggaaaagtccaattcgccattcggacattgaaaccatcaccattcaccagtcaccaccttcttcctcgcatcgttcgtcttctgtctgtggatttcaaactctgccatttcgattccttcgttcatcgttattttgcttgactattgtagaggctgcagcctggatgattggtgggctttaagcttgtgaaagaataattactggatggaacttgcaagacctgcctcaagtagaagaaaattgaaagatttattgcatcagagtggtaatcgtctttgtgctgattgtaatgctccagatcctaaatgggcgtctgccaacattggagtttttatatgcttaaaatgttgcggtgtgcacagaagccttggtactcatatatcaaaggtgttgtctgtgacattggatgattggtcagaggatgaaatagatgcaatgatcgaagttgggggaaatgtttctgctaattcaatttatgaagcttatattcctgaaggatatacgaaacctggaccagatgctggtcatgagcagcgttcaaagttcatacggtcaaaatatgaattacaagaatttctgaaaccgagtttgcgcattgtgtctggaaaaagcagtctacaatcaagttctgccaaaagtagttttatggacagttttaaaagtactagtagttcacagagaatggaaggtatggtggaatttattggaatgttgaaggtgaaagtgattaaaggcacaaatttagctatcagagatataaagtcaagtgatccatatgttgttttgagccttggccagcagactgtccagacaactataataaggagcaacttgaatccagtctggaatgaggaatacatgctgtctgttcctgagcattatggacagataaaattgaaagtatttgaccatgacacattttctgctgatgatataatgggagaagcagacattgatcttcagtctctgataacatctgctatggcatttggagatgctggaatgtttggtgatatgcagataggaaaatggttaaaatcggatgacaatgcccttattgaggatagcacagtcaatattgttgatggtaaggttaaacaaatgatgtcactcaagctccaggatgttgaatctggagaattagatcttgaactcgagtggattcctcttgagcaatagggacttgactgctgttggcctatgctttctcttagaacaaattgtctgtaattttttctcttcactttttgattcatcttcctagaagaacaaataaacctgtatttttgcctttttaatttgaccaaacattcagtaaattttcttcatataaaagaacgagagagaaatgtcagacgtgacaaaaaaaattcagatgaaaaaaaaa

SEQ ID NO: 284 - DNA, 1406 bp, Glycine max
  misc_feature (1)..(1406): Glyma.U032500.1
gatagtaaaaccggcaaacagggccttgtcctcacacgagacacgcacacgtataaatagggcgaaaactcaaaagagttaaatcactcacacactctttcttaagttctcagaaaccttaaaaacaacaacgtaggagtgttcggaaaagatggctaagcaggaagtggtggaagggttcaagttcgagcagaggcacgggaaagaacgcgtgagagtggcgcgcgtgtggaagacgaggcaggggcagcacttcattgtggagtggcgcgtggggatcactctcttttcggattgcgtcaactcgtacctccgcgatgacaactctgacatcgttgctactgataccatgaaaaacaccgtgtatgcaaaagcaaaggaatgctctgacatactttctgccgaggagtttgctattctgcttgctaagcactttgtatcattttaccagaaggttactggtgctattgtgaatattgtggaaaaaccatgggagcgtgtcactgtggatggtcaacctcatgaacatggtttcaaacttgggtctgagaagcatacaacagaggcgatagtacaaaagtctggttcacttcagttgacttctggtattgaaggattgtcagtgttgaagacaacccagtctggttttgtgaatttcataagagacaagtacacagcacttcctgatacccgtgaaaggatggtagcaacagaagtaaccgcactgtggaggtattcgtatgaatcgctgtatagcctccctcagaagccgctttactttacagaaaagtatcaggaagtgaaaaaagttctggctgacactttttttggcccaccaaaagggggagtctatagcccatctgttcaaaacacactctacctgatggcaaaggccacactgaacaggtttcctgacatagcttatgtcagtctaaagttgccaaatcttcatttcatacctgtcaatatctcaaaccaggatggccctattgtgaagtttgaggatgatgtgtacttgccaacggatgagccacatgggtcaattcaagctagtttgagccgcctttggtcaaagctgtagaaactgcagaaactatggtgctcatcccttctggtggattgctagtgcagcctaaactagcaaacctggcctcagataatgctttccattaatgtgtcttgtaattctggtttttgttatctttatcttttgttttgtttcatgaagaactattatgcatgaataacttccaggagggatattctgtgggttgcaccaatgttaagctttttgtttctactattccaataatttcctagtgtccttgtggaatctgaaataagtcttactatgacgttgatgcaatgcttttttatggtcatataaagatggtcatactcgtaca

SEQ ID NO: 285 - DNA, 2698 bp, Glycine max
  misc_feature (1)..(2698): Glyma.10g241900.1
ggagagatgtataagaatgtttccaccgccaaagctataaatccgaaaacctcgtcggcgcttactcctttttgttctcctgcttctgcacctcattgccataccccctttcaagcaggagaaaatctctcgctccctttctctttcttctcttcacgccgccatcaccatgccttcactctctctctctgaaactgacaccaccacccctaaacctatttccaacaaaaagaaaccaaagacccaatccctcactgatcccgacctcgatggggtttcggggaagaagacgaagaagcgcaaggcttcagatttattagaaccagaggccatgcccgccgcttacagctacaacaatggggacgacgagaccagctccgacctcgtcgaacccgaacctgcttccagagaagacgacagtcagaataaaaagaaaaagaagaaaaaggttgtcaagtccgaagaaaaagaacagcctttgttggtaacggagcctaaagaagaaaagaaggatgaccccaacgcgatttccaacttcaggatttcggaaccattgagggagaaattgaaggagaagggtatcgaatcgctgtttcccattcaggccatgaccttcgacaccgttctcgatggttctgatttggttggccgtgctcgcactggtcagggtaaaactctggcatttgtgttgcccatattagagtctttaataaatggtccagcaaaatctgcgagaaagactggctacgggaggactccgagtgttctcgtgcttctacctactagggaattggcttgccaggtgcatgctgattttgaagtgtatggtggggcgatgggattgagttcatgttgtttatacggtggagctccatatcaaggtcaagaacttaagctgaggagaggtgttgatattgtcattggcacaccaggccgtgtgaaggatcatattgagaagggaaatattgacctgagccaactaaagtttcgtgtccttgatgaagccgatgaaatgctgaggatgggttttgttgaagatgttgaaatgattctaggcaaggtagaaaatgttaataaagttcagacacttcttttcagtgctactttgccagactgggttaagcaaattgctttaaaatttttgaagccagataagaaaactgctgaccttgttggaaatacaaaaatgaaggccagcaccaatgttaggcatattgttcttccttgtactagttctgccagggcccaacttatcccagatattattcgctgttatagcagtggaggccggacaattgtatttaccgagacaaaagaatgtgcttctcagcttgcagggatcttgaatggagcaaaagctctccatggtgacatacagcaatcaacacgtgaggttactctgtctggctttaggtctgggaaattcatgacattagttgccacaaatgtggcagctcgaggtcttgatatcaatgatgttcagttaattatccagtgtgaacccccacgagatgtagaagcctatatccatcgttctggacgcacaggaagagcaggtaatactggggttgctgtcatgctttatgatccaaaaagatctaacatacctagaatagaaagagagtccggtgtaaaatttgaacacgtatccgcccctcagcccgatgatattgccaaagctgttagtggggaagctgctgaaatgattatccaagtgtctgatagtgtggttcctgcattcaagtctgctgctgaagagcttttgaacagttctggtttaccagtcattgaattactggcaaaggctcttgccaaggctgttggttataccgatgtaaagcaaagatcacttctcacttccatggagaactatgttacattagtccttgagactgggaaaccaatctatacccaatcttatggctattcaatcttgaggagatttttgcctgaagagaaggttgaggctgtgaaaggtctttcactcactgctgatggaaatggcgttgtttttgatgtaccagctaaagatttagacatatatcttaatggtcaggaaaatgcctcgaatgtatgtttagaggtagtgaaaacactgccacagttgcaacagaaagagccacaatcaagaggtggcagatttggtgataatggtggtcgtggtgggaactacaggtttggtggaagaggtggaggaggcaggaatggtaggttctccaatggtggtgggcgtggcggcaactggggtggaaagagatggtgaagctgagaagggactttgggagttgagtgttttcactctgctcggtgtgggatcataactgcgtgacgaccacgtggggatgaatacttcagtcgtgaatgaagaaacagttgatgttggttaaggcccacggaggattcgagttcaagatggattcaatgtgtcccctaacaacatattctatgtttcatttttgttttgttattttttattcttttgcggggaagcgtaagtttagatttttatattctgtctttcacaggagaaattttgatgtagtagtatatacttttacgatatcaagcgtggcaaattccatttagccagcgaacataatatttctagcatctgcaggtaatgcaatgagtaaaaacccagtgtttaatattttggaagaaaatgtaggtaggtttaattcttataaaactgatttct

SEQ ID NO: 286 - DNA, 2449 bp, Glycine max
  misc_feature (1)..(2449): Glyma.02g056800.1
acaaactccacaaattaacaaaatgtggcgaagaagcttcagtagcagcaccgccgctctgaagggcaagaaatgggacgcgctggtaatcggcggcggccacaacggcctgacggcggcggcatacctcgcgcgcggaggcctctcggtggcgatactggagcggcgccacgtgatcggcggcgccgccgtgacggaggagctggttccggggttcaagttttcgaggtgcagctacctccagagcctgctgagaccgtcggtcataaaggagctggagttggggaagcacggcttgaagcttctgaaaagcaatccgtcgtcgtttacgccctgcctcgacggacgctaccttctcttaggtcccgataaggatctcaatcactctgagatctccaaattctcactcaaagatgctcaggcttatccaagatatcagactcagcttgagagtttctgtaagttcatggatctagtgctggattcgccgccacctgaatctgtgcaccataaatcgtctattaatgaaaaattgaagaataaattacagaattctgtattttgggcaagttgtctgcgacaggtgtcttccttggggcaaaaggatatggtggactttatggaccttctgttgtccccagcttctaaggttttgaacaactggtttgaggcagatgttctgaaggcaacccttgcaactgatgctgtgataggcagtacagccagtgtccacaccccaggaagtggctatgtgctgctacatcatgtgatgggagaaactgacggggaacgtggaatttggtcatatgttgaaggtggaatgggctcaatatccaaggctattggtaatgctgctattgaagctggagcacatgttgtaaccaatgctgaggtgtctcggttgttgattgaaaactctagcactgtctgtggggtggctttggctgatggtactgaagtgcattcttcaattgttttgtctaatgcaactccatataaaactttcatggaattagtgtccaacgatgtccttcctgatgattttgttcgtgccattaagcacactgactacagttctgctactacaaaaataaatgtagcagttgataaattgcccgaatttcattgttgcaagttagaacaccctcatgctggcccacagcatgtcgccacaattcatataggttcagaaagcatggaggagattcactctgcatgtcaagatgcagtaaatggagtaccgtcgagaagaccggttattgagatgtcaattccctccatactggacaaaactatttctccacctggtaagcatgtgatcaacctgtttgtgcagtatacaccctacaaaccattggatggtgactggcaagatcatgactacagagaatcgtttgcacaaaaatgtttcacattgattgatgaatatgctcctggcttcagcacatcagtcattggttatgatatgctgactccaccagatcttgaaagggaaatcggtttgacgggagggaatatattccatggtgctatggggttggattcccttttcctcatgcgacctgcaaagggatggtcaaactacaagactccgcttaaagggttatacttatgcggaagtggggcacatcctggtggtggtgttatgggagcacctggacgtaatgctgctcgtttagttcttcaagaggttggagaaagaacttaagtggtgatatactgagttatgattctcgcccaaattattactgcttgcaaactggcttggaaagatggctctttcattggaattttatgcagtaactaatgtaaatttgcaatgcgtaagatagaagaatgaagaatcgtgacaatgattcatcaaattggatgagcttcataacaaagatacagaagctgtaatgtggatttcagaaaactagaacttgtaatccttttttataatttaacagctgttcaatgcattgattccagtacttactggtcgacacaggacatccacggttgatcatgaattataatgtgtagtgtaggaaagtatttatacgaggacaacatttcaagtaaattgaatcaaacagattaactgaaattgggatcagctgggaacaatgagtgctcagtaaagttgtacacaacattttttttatcaacaaggtagggaatcgatcacaaatacaaactcaccagtagaaaccatggtcaactcaaaactgtaattcagggtgtcaatcgttgtttcaattaggagcacttacactagggttttggacaaagacatcttatggacttccctgaatatagatagttcttcacctgtctgaaccctaggatgcgtagacgcagatccttccggaacttcaattgaaattatattactgcgacctccaaccagaaactgattttggaacaagattgattgctttggatgctgattcgagcctgcttt

SEQ ID NO: 287 - DNA, 3134 bp, Glycine max
  misc_feature (1)..(3134): Glyma.16g014200.1
ttaatttataagaattttctgccgctccaaaattccttccagcttcgttccaccgtgtatgttcgttgctgtttgctcgatcccctccaacgtgtccctccacccaggcagggtttctatttcacttttccttccaccgatactaccaaagaacaaggagatcgcaatcgcaattcttaattctcacacgcactttcgccaaatcgaagtacattattgattccttccgtgatgagagagcccagagatggagccaataacaagccctctaaagccgccgccgccgccgccgcatcaccgcctcagtccttccctctcattctcgacgtcgacgatttcaagggagacttctcgttcgacgcgttgttcgggaacctcgtcaacgagcttcttccgacgttcaaattggaggaatctgaatcggacggcggagatgctctcccgaacggccatctccgcgtgccatccaccgatgggtccaagtactcgcaggggattgtgagtccgttgtttcctgaggtcgagaagctcctgtcgttgttcaaggattcttgtaaggagctgcttgagcttcgtaaacagattgatgggagactctacaatctcaagaaagatgtttcggttcaagactctaagcatcggaagacacttgctgagctagagaaaggtgtggatggattgtttgacagctttgcgaggttggattcacgaatttcaagtgttggtcagacagcagcaaagataggtgatcatctccagagtgcagatgctcagcgagaaactgccagtcaaacaattgagttgataaaatacttaatggaattcaatagcagcccaggcgacctgatggagctttcacctcttttttctgatgatagccgtgttgctgatgctgcttcgattgcccagaaattacggtcatttgctgaagaagatataggaagacatggaatacctgtcccatcagctatgggaaatgcaactgctagcagaggattagaagtagcagttgctaatttacaggactactgcaatgaactggagaatagattgctttctcggtttgatgcagcatcacagaaaagagaattgaccacaatggcagaatgtgccaaaattttgtctcagtttaacaggggtacaagtgccatgcaacattatgtggcaacacgtccaatgtttattgatgtggaaataatgaatgcagacactaagctggttcttggtgaccaggctgcccaagctagtcctagtaatgttgctcgtgggctttcctccttgtacaaagaaatcacagatactgttcgtaaggaagctgcaacaatcacggccgtattcccttcaccaagtgaagttatgtcaattttagttcagagagttttagagcagcgaatcactgcccttttggacaaactgttagagaaaccatctcttgtcaatttaccttccgtggaggaaggtgggctcctattatatcttcgaatgctggcagtggcgtatgaaaagacccaagagctagcaagagatctacaagctgtaggatgtggtgacttggatgttgagggtctaacagagtccctattttcaagtcacaaggatgaataccctgaatatgagcaggcatctcttaggcaattatataaagtgaagatggaagaactgcgagctgaaagccagcagatttctgatgcatctgggtcaattggacgctcaaaaggagcttcagtagtttcttctcaacagcaaatatctgttactgttgtaacagagtttgtgcgttggaatgaagaagcaatctcaagatgcaatctctttgcttcccagcctgctacacttgcaacccatgttaaagcagtgtttacttgcctgctagaccaagttagtcaatatatagctgatgggcttgaacgggcaagagacagcctgactgaagcagctaatttgagggaaagatttgtgttgggtacaagtgttacccgtagagtggctgctgcagctgcatctgctgcagaggcggcggcagctgctggtgaaagtagtttcagatctttcatgattgctgtgcaacgttctggaagcagtgtagctattattcaacaatactttgctaattctatatctcggcttttgctccccgttgatggtgcacatgctgctgcttgtgaggaaatggctacagcaatgtcaagtgcagaggctgctgcttataaaggactacaacagtgcattgaaactgtcatggctgaggtggagcggttgctttcagctgaacaaaaggctacagattatcgatcacctgatgatggaatggctcctgaccaccgggcaaccagtgcctgcacaagagttgttgcttatctttctcgtgtgctggagtctgcatttactgctttagaaggccttaacaaacaagcattcctgactgagttgggaaatcgcttgcacaaggtgctactaaaccattggcagaagtatacttttaatccaagtggggggttgcgactgaagcgtgacattactgaatatggagaatttctgcgtagtttcaatgctccgtctgttgatgaaaagtttgaattattgggcataatggccaatgtatttattgttgctcctgagagcctttcaactttgtttgagggcacacccagcatacggaaagatgcacaaaggtataactacattggatctgtaaatgcaataatttatgttttatggtcttgttattattactagtatcaccactaccacagccaccaacatcattataagttgactaatgatggtatatgtatataaaaaaagatcttttcctatttctgttcaatttccagagatttcatatgtttaggttcattgttcgtattgtttccatttttcattaggctatttatgttacaattttttttttttttttgtgtgtgtgtggtcttatgagcttatcttacactcgtaatttgtttcataaagcttttttggggtgagaataatcgccaattttgatattagttgtccctccacacaaacacttgacacttaaccacactttgtggttagccgcaaggtaatttggttatttaagatgacaactattaagggctccattaagataagtggatcaaatggatgattgt

SEQ ID NO: 288 - DNA, 7292 bp, Glycine max
  misc_feature (1)..(7292): Glyma.14g162300.1
ttcctcctcctaccccctcttcttcgttataaatcaaccttctcctctctcagcaacaaccctcacaccacacgccctcagccgtcactctctctctccctcgtctgttccttcctcctcagtcttggtattgtgtctgcaacttacgagacagccctttttgtgattcgaatctcttttaagctttaacctcttcaattgttaccgttccatcacaaccccgtgcttaataagccatttcacccaaatccggatcttattagatcaataaattcagatctgtttcttttaatgtgaaaaaagccccaatccttttcattatttttggatatatttcttttttactttgtctattaaggcggttgtaagttgtaacagaatttggacgctgaaataagagttcccacaaatacaagaacacttcttcactgaacatattaaaaattattatagcaaaaaaagaaacaccaacaccaaggcttttccttttatctctttttatttgttgttgttttctgtaagggaacaatgtcgaacgcgctgtcgtttacgctcccggctctcaacaaccctcagctaaacgctttgaatagccctaacaaggcgcgtctgcgccacggcctgagaatccgggttgttgcgtcgtgcatagagaggaagaggttcttggggacccgggtgcggccaagtgggtcggacaggatctggttgctgcagtcgggtcgggtgccgaagctgagggtggcggtgcggtcggcattctcggcggtgccggagaagccgctggggctgtatgatccggcgatggacaaggactcgtgcggggtcgggttcgtggcggagttgtctggcgagagcagccgcaaaacggtgacggacgcgctggaaatgttggtgcggatgacgcacagaggtgcatgcggatgcgaagccaacactggagatggtgccggcattcttgtggctctgcctcatgtcttttaccaggaggttgtggattttgagcttcctccgcaaggaaaatatgcagttggcatgcttttcttgccgaagtctgagaaacgaagggaggaaagcaaaaaaatgtttagcaaggttgctgaatctctggggcacacgattcttggatggcggtctgtgcctactgataatgcaggattgggaaaatcggccctgcagactgaaccagtgattgaacaggtgtttcttacaccaagtgctaaatcaaaagttgatttggaaagacagatgtacatattaaggaagctcagcatggctgctattacatctgcattaaacctccaaaatgatggcattacagatttctacatctgttcactttcatctaggactgttgtttacaaaggtcagctaacaccagctcagctgagggattattactttgcagatattggcaatgaaaggtttacgagctacatggccctgatacactcacggttttctacaaatactttccctagctgggatcgtgctcaacctatgcgtgtattgggacacaacggagaaatcaacacactcagaggcaatgttaactggatgaaggcacgtgagggtttactcaaatgcaaggagcttggtttatcagagaatgaattaaagaagcttttgcctattgtggatgcaaattcgtcagattcaggagcttttgatggtgtgcttgagtttttgcttcattcgggaaaaagtcttcctgaagctgttatgatgatgattcctgaagcatggcaaaatgacaagaacatggattctcagcgtaaagcattctatgaatacttctcagctctcatggagccatgggatgggccagctcttatatcatttactgatggtcactatcttggagctacattggataggaatggactgcgaccaggccgtttctatgtcacccatagtggacgagttattatggcaagtgaagttggggttgtagacattccaccagaagatgtgcgtaggaaaggaagactaaatcctggtatgatgctgttggttgattttgagaagcatatagtcgtaaatgatgatgccttgaaagaacagtactctttggcaagaccttacgaggattggctcaaaaggcagaaaattgaactcaaagacatcgttaactctgttgatgaatctgaaagagtgccgccacccatagcaggagttgctccactatccaatgatgatgcggatatggaaaatatgggaattcatggtttattggctccattgaaagcttttggatatacagttgaatcattggaaatgctattacttcctatggccaaggatggcgtagaagccctagggtcaatgggaaatgatactccattggctgtcatgtctaaaagagaaaaactcactttcgagtatttcaagcaaatgtttgctcaagtgacaaaccctcctatcgatcctattagagagaaaatagtcacttctatgcaatgtatggttggtccagaaggtgatctgacagaaatcactgaggagcaatgtaaccggctttcactaaaaggtcctcttttatccactgaagaaatggaagccattaaaaaactgaattataagggatggcgcagcaaagttatagacataacttactcaaaggaatgtggtaagagagggttggaggaagccttggacaggatttgtgcagaagcacaccatggaattagtgaaggctacaccactcttgtgctgtctgatagagccttctcaaagaaacgtgttgctgtgagctccctccttgctgttggtgctgtccatcaacatcttgttaaaaatcttgagcgcactagagttgccttaatagttgaatctgctgagccacgtgaagtgcaccatttctgcacacttgttggttttggtgctgatgctatatgcccgtatttggcagtagatgcaatttggcgactgcaggttgatggaaagatcccaccaaaagcaagtggtgaatttcactcaaaagatgagttggtcaagaagtatttcaaagcaagcaactatggaatgatgaaggttctggccaagatgggaatatcaactttggcatcatacaaaggtgctcagatttttgaagcattgggtctttcgtcggaagtgattgcaaagtgctttgctgggactccaagtcgagttgagggtgcaacgttcgagatgcttgctcgtgatgcttttcaactacatgagttggcttttccttcttgggttttctctcctggaagtgcagaagctgttgctttgccaaatcctggggattatcactggagaaaaggtggtgaagttcacctgaatgatccacttgctatggcaaagcttcaagaggctgccagaactaacagtgtagatgcatataaacaatattccaagctcattcatgaattgaacaaggcttgcaatttgcgtgggcttctgaaatttaaagagacagcagttaagattcctattgatgaagtggagcctgctagtgaaatagttaaacggttttgcactggggccatgagttatgggtcaatatcattggaggcacacacagcattagcaatggctatgaataaaatgggagggaaatccaacacaggtgagggaggggagcaaccatctcgtatggagcctcttcctaatggctcaatgaatcccaaaaggagtgccattaagcaagtggctagtgggagatttggagtttcaagttactaccttacaaatgctgatgaactgcagataaaaatggcccagggagcaaaacctggtgagggaggtgaacttcctggccacaaggttataggagacattgctgtcactaggaattcaactgctggggtaggacttatcagtccacctccccatcatgatatttattcaatcgaagaccttgcccagctaattcatgatcttaagaatgccaacccagctgctcggattagtgtgaagttggtatcggaagctggagtggggataattgctagtggagttgttaaaggccatgccgaccatgtattgatctcaggtcatgatggaggtactggggcttccagatggactggcataaagaatgccgggctgccttgggaacttggcctggctgagacccaccaaactttggttgctaatgatctacgtggtcgcacagtcctccaaactgatgggcaactgaaaaccgggagagatgtggccatagccactcttcttggtgcagaagagtttggtttcagtactgctccgctcatcactcttggctgcatcatgatgcggaagtgccacaagaacacttgtccagttggcattgctacacaagatccagtacttagagagaagtttgctggagaacctgagcatgttatcaacttcttttttatggtagcagaggaaatgagagaaattatgtcccagcttgggtttagaacagttaatgagatggttggccattccgatatgcttgaatttgataaggacgttgttaagagcaatgaaaaactagagaacattgacctctctctattgcttagacctgcagctgaactgcggccagaagctgctcaatactgtgtgcaaaaacaggatcatggtttggacatggccttggataataagctcataagtctgtctaatgctgctttggaaaagggtcttccagtatacattgaaactccaatctataatgttaaccgtgctgtgggaactatgcttagccatgaggtgactaaacggtaccacctagctggtcttccaactgataccatccatgttagatttactggcagtgcaggccagagctttggtgcattcctctgtcctggtatcactttggaacttgaaggtgatagcaatgactatgttggtaaaggattatctggtggcaagattgtagtgtatcctccaaaagaaagtaactttgaccctaaggagaacattgtgattggtaatgttgcactgtacggggcgacatgtggggaggcttatttcaatgggatggcagcagaaagattttgtgtgcgtaattctggagctaaggctgtagtagaaggtgttggtgatcatgggtgtgagtacatgactggtgggactgttgttgtgcttggtaaaactggtagaaactttgctgcaggtatgagtggtgggattgcttatgttcttgatgtggatggaaaattccaatctcgatgcaacttggaacttgcagatctagataaggttgaagaggaagaggacattcttgcacttagaatgttgatacagcagcatcaacgtcacacaaatagtctgctagccaaagaagtgcttgatgattttgagaatcttcttcctaaatttatcaaggtgttccctagggagtataaacgtgttcttgcaagtatgaagtctgaggaaacctccaaagatgcattggtgcatgctgctaaagacgaccaagatgatgaagcacaagcagtggagaaggatgcttttgaagagcttaagaaactggtgatggcatctttgaatgaggaaccgagtcaggaaaattctggatgtcctcttggaaataaaataccagaatttaacgagttagtataccaaaatagatggcgtgaagcattagagaggcttcttgaaacaaataactttccagagtttactggtcgggtgtgcccagcaccttgtgaaggttcttgtgtccttggtattattgagaatcccgtatccattaaaagcattgaatgtgccatcatagacaaggcttttgaggagggttggatggtgccacgacctccagtcaagagaactgggaaaagagtagccatcgttggaagtggaccatctggcttggcagctgctgatcagctaaataaaatgggtcatacagtaaccgtgtatgaaagagctgataggataggagggcttatgatgtatggggttcccaacatgaaaactgacaaagtggatatagttcaacggcgagtaaatcttatggctgaagagggaatagattttgtggtaaatgctaatgttggacatgatcctttatacactcttgatcggcttcgaggggaaaacgacgccattgtcttgactgtaggagctacaaaacctagggatcttcctgtacctggtcgggagctgtcaggagttcattttgccatggagtttctccatgcaaacactaaaagcttgcttgatagcaatctccaggatggtaactacatttctgccaagggcaagaaagttgtggtcattggtgggggtgacactggcacagattgcataggaacatccattcgtcatggttgtagtagcgttgtaaatcttgaactccttcctcagccaccaccaactagggctcccagcaatccatggcctcagtggcctcgcatattccgtgtagattatggtcaccaagaggctgcagccaaatttggcaaagatccaagatcgtacgaggtactaactaagaggtttatcggagatgaaaatggagttgtcaaaggacttgaagtgattcgtgtttgctgggagaaagatgaaactggaaagtttcagtttaaggaaattgagggatcggaggagattattgaggctgacctagttttactagccatgggattccttggtccagagtctacaattgcagagaagttgggtgtggagcgagacaacaggtcaaacttcaaggccgattatggccgcttctcaactaatgtcaaaggggtgtttgcagccggtgattgtcgccgcggtcagtccctggtggtgtgggcgatttcagagggacggcaagcggcagcacaggtggaaaactacctcatcaaagaagaccaagaccacaggaatcaagatgggcttgtcaagaggcagcagggcctcaacatgaagcagcagggcagcaacaaacacacagtaatgacttaggtggcttctctgatttttcatgctcataaaattccaaaaggaatttgcacagaataaaataagattgttccaagtttgagcaagagattcattggtttactttaggtattcttggttggcagttgctacccaaaggggcgaaataagcataaataaagtgaagcttagtgcagagaaagcaagagttgttttggtgtttggtgtggtcttagggtatgaagttattgcagattcgagtgttcagttgttcatagattgttttattcgggctttattgttgggaaggttaactttcttagttggtaatggtgacgatgattgcatgtaatgaaatatacaatttgattattatttagatgttacatcgtttcaatttttaaactttgtttttg

SEQ ID NO: 289 - DNA, 3704 bp, Glycine max
  misc_feature (1)..(3704): Glyma.15g255100.1
tttagggttttttgggcacaaaaaacaattctcaaataaatctcaatcaatatctttgcagttgtagggttctcctttctctctctctctctcttttatctactgtctccctttcttctccttcgctttgatccgaattataatccttttttcatgtgctaaatcatttgctcggatattcttcttcttcttcgtcttccccttttgcttcggtttaagtttcaagttttgcacggatagtgtttcaagattcaaactttttcgtattgggttctcttttctttttgaatttttttttttttgtttttctttctgggttttctgttttcatggtggatatggatgggtttagagctgggggtcatgttgggggaactcccaacacagaggatcttgggcaactgggaaatgctcccacagagggtgcagtttttgatgcatcacaatatgcatttttcggttcagacactgctgttcaagaagttgagttgggagggttagacgatgatgatttgcttgagtctaatgcggagttcattctcaatagagaagaggccgaggatttaaaatctctttctgatattgatgatctaagtactactttttggaagttgaacaaggttgtaagtgaaccaaaaggcgcaggatttattggtgaacagggatcgagagaaaattctgcagttgaatgggcacacaaagatgatgttcttaattggtatcaacaaaatgcttatgataatgaaggttctttggatggcagaagaatgtcatcacaacctcattcttctctttctcagttacatgaaccaaaggccctgtacagaacatcctcttatcctgagcagcaaaggcagcaacaacatctccagctccaacctagtgaatcggctcccaactggattgatcaacatttgtatggtacggaaaccactcaggatggcaaacgatggtcatcaaaaccacattccaccattgcacacttaccagagtcaaggcccttgcatagaacatctttatatcctgacaagcagcaggaattttctcatctttctagtgaaccaattttggtaccgaactcctcatttacttcttatcctccacctggtggtagatctcatcaggcttctccaagtcagaattcaggccacttaaaccttccttatcatgctacaggagctcagatggcattatcaccaccaaatcgatctcatttccccaattctgcattacagttgagtggaataaaccatgggccaccttttggtggaaacatgcgtcaattttctactggttcccctcttaatcagataattcagaatcaattggtaaaccaggcagggttatatcctggagatcaccccaatatttcatcaggtatacccatgattaacaaatatgatcagatgcttgggctgatggaattgcgggatcaaattccaaaatcagctcaattaggtagacagaatctccggtttcccccacagggttttgatatgggtggcctgagaagcaatagtggatggccccgatttaggtcgaagtatatgactactgaggaaattgagaatattcttagaatgcagcttgtagcaacacacagtaatgatccatatgttgatgactattaccaccaaggctgtcttgcgaaaaagtcatctggtgctaaattgaggcatcacttttctccagctcaaataaaggaactccctctacgaccctcttctaatgctgaaccacatgcttttcttcaggttgatgcactagggagagttccattctcatcaattcgcaggcctcgtcctctactggaagttgatcctcccaattcctctcatgcaggtagccctgagcaaggcatttcagagaaaccccttgaacaggaaccaatgcttgcagctagggtcactattgaagatggtatttatcttcttcttgatgtagatgatattgaccgtttcctacagtttaatcagcttcaagatggtggtcttgtgttaaaaaggaaacggcaaggtcttctggaaggacttgctgcctcacttcagttagttgatccactgggaaagaatggacatacggttacacttgctgcaaaagatgactttgtttttctcaggatagtttctctacccaagggtcgaaagctacttggtaggtaccttcaactgctatttcctggtggtgagctcatgcggacagtctgcatggccatctttcgtcatttaaggttcttatttggtggccttccctccgatccatctgcagcagaaactataagtaaccttgcaagggttgtttcaaggtgcattcgtgaaatggatctcagtgcaataagtgcttgtctagcagcagttgtttatacttccgagccgcctcccttacgtccccttggaagttctgctggagatggggcttcccttattctagtatctgtgcttgagagggcaactgagcttctaactgatcctcatgctgctagcaactacaatattgcaaatcgttcgctttggcaggctacatttgatgagttctttggccttctgaccaagtattgtgtgaacaaatatgatagtgtcatgcaatcattccttatacaagggacaccaaatatggcttccattggttcagatgttgccagagctattagtaaggaaatgccagttgagctcctacgtgcaagtctacctcacactgatgaccgccagaaaaaacaattacttgattttgctcagcgttctatacctatagttggatttaatagtaattcggggggtcaaggtcaccatgtgaactcagagtcagtcctgagttaattagataattggacattcatctaaagaactgtttttcaaatgacggcagtaaatttctcagggacaactattgtgtgtctaatctctttggagcagcctgatgtggaaggatcaggagcatgcatctaccttagaagttttagccccttcatatcttgttatattgcggtaatgccatgtagcattgtgataaattggcagtcaggccctctgtgtattatgatagacttggcttgatttgttcctcttgtcctgtctttttttcttttgacaggggagcttagtgttgctcagtttgtggtttctagagcaaactagtgggtagtatgtccaaggtttaggtgttcaagttggattcccatgttcctttattattaccatacaggcatgggattgtggttgtgttcatactccatatctacctatatagatatcacacgtccaaattgaagtagcattgtggggtgcaccaatttaaccagtcggcaaggtggcattggcatgcctaagaataaattgtgttaaccttgtttcttggtttcagtttcctcaccttttccattggtgtagacgcctagttttgtgtcatcatttcttgtttctcaagtcaattggactattattggtctatcgttgttatccccacatcggtatgtcttgaatttaatgttttgcttatatatatgattttggaagtatgtttttgcatttgctactaccataagcaatttatggaattttggaatagttaaagtaatgcagatgttggttgagatgttatggttgattctagactttgttgactctgtactagaatgaatttggtctctgaatcatgctttgtgccagccaaggttttttatttcccagatttccttgtcagtcttt

SEQ ID NO: 290 - DNA, 2245 bp, Glycine max
  misc_feature (1)..(2245): Glyma.06g271800.1
aaaattggaaagaaaaaaaatccagagtggtaaaactcccttcccaccactcccatcaagttttttccgagaatggaagaataacatagacgtgtagctcttcctcctcccactccatagtgttgctactccttcaattcccaaaagcaatgtcagagcgagacatagcttgggatttccatctccgtaagctctctgctagcggcagagactccaacaccgccaacgatcctgcttccgattcatctcttcttccttcggtgaagaagcttcatgaaatatgcaagaacgagtactccgaggacttggtagctagggtttatccatccattaacaagattttccagcgcgctgtcgcttccctctctcaatctcgaacctccaatggccttcttttactcgaaattcttcagttttacctggactttggggaggttgttcttcatgatgcggatcctagtctcaggacattttttcgtttgtgcttgagcagggaatttgctgatcctgttgttgcagaagcaacgcttgaatttctcatcatcaacaagaagaagcttctaacttccttccctaacttattgcctcagttttttccattgttgttaaagttggttgcttggaatggtgaaagattagagaaactatttttgaaagcctttccgggcttgatgtcacctgggtcatttatttccttatttccatctttagtagacttgccaattttggtagtagcattggaaaaggtggaaaaaagctcaggaccactaattgggagcagcatagcttctattcagaaaaatactgcccctaagatgctacttgcccttatggatgaggcatatactggttcaactatagaagatggtggaggagattctgaatctgaggataacagtgcaattgatgtagctgatccgtttttccttgaacttttaaaggatgaaaatgatggtatcgctgaacggccctggtcgtctccagtgatggctgcgatattacaagcttcggtcaatagtccttattctgataggctgaaggcagtactcaacatggctcctcatcttcttgatgtgtacttctccatagcattgcatactgtcaataattctttgatttgtgcattgattcccctgcttatgtcaagatttgcaacaatatttccggacaaaatattttcctatgaggttcgcaagcgacttttggagtttatgctctctacatttcagtgttcaccaaatttcattgcccttttaaagaaacctataatggacagacttggagaagcttatgacagcccagagaagacagaattggccttgcaactatgttgggccattggagagcatggtggaggtggtggatctcacaaagatgaagcccgtgagctttttgagagtttagaactgcttctgtatgaaaacctttcctcaagtcgtgtgggcatgactcaggaggtatccgatgaggatacttacagaaggtcatcacagtccaggcttttatgttttgttgtgacagccattgcaaagcttgctacgtatcatcgagagttactgccaagagcacgtgtgtccttgggcaaggtggctcggtctcgaatttcagatcctagagtatggagacgtgcatgtgatttcctgggtttgatgaaagaccctgctatatgtgcatccatattggggccttcacgtcctgcacaaggcaccacacagaaagtaggcagcataaactggagtgaaggttcaacgaagatgattgcacatattccgttttacattctaggggaacaagaagggccaccttttcatgatttctcattctcagatatcattccaagcatatgattgaagctgaaattgtaccaggtggtcatcttggtagttgatatcattctgatctatcctacattgttactttcttaaatctgtatattattaagccttccgtaaataagcaagttcactttttagttatttgtccagatttctggtttattgcttggcttttagcattgaatcctaaagattaggattctacttgtaggcggacaagtttgagtagatttggctcttttcttgttgaaactatgattttgtccggcccattggaaaatatttagaccaatgtaatgtgattttcctgttaaatttggttatttaaaaaagttacggtttctattgaggtttgtggaacccgtcatacttcaaaataagcgatgagaaagtgagcttggctatttgtg

SEQ ID NO: 291 - DNA, 4466 bp, Glycine max
  misc_feature (1)..(4466): Glyma.19g250600.1
ttttagtccatacagaaaatgatacctgctcacagacttgcaattgaagactctgtgatgtttatgtacctaccgagtagtggagagagagaaattgagaaacgaagcaattgtagtttatctttcctccgttgttgttcttcttctatgcttcgcgttctgattttcccccacgattgactcaggatttggctatggctgtacccgtcgaggaagccattgcagctctatccacattctcgctcgaggatgagcaaccagaggtgcagggacctggagtgtgggtatcaactgagagaggtgcaacagaaagtccaatagagtatagcgatgtttctgcttacagactatctctatcagaggacacaaaagctctcaatcagctgaatgctcttacccaagagggaaaggagatggcatcagtgctttacacatatcgtagttgtgtcaaagcacttcctcagctacctgattctatgaagcaaagtcaagctgacttatatttggaaacatatcaagttctggatttggaaatgagtcgtctgcgtgaaattcagcgttggcaagcatctgcttcctcaaaattagctgctgacatgcaacgtttttctaggcctgaacgacgcattaatggccctacaatatctcatttgtggtctatgttgaagttgcttgatgttttggtgcaacttgatcatcttaaaaatgctaaggctagcatacctaatgacttttcatggtataaaaggactttcacacaagtcagtggtcagtggcaagacactgattcaatgagggaggaattagatgatttgcagattttcttgagcacaagatgggctattttgttgaatttgcatgttgagatgttccgtgtgaacaatgtagaggacattcttcaagttcttatagtctttgttgtagagtctttagaattggactttgcacttctctttccagagcgccacgttcttttgcgtgttttgcctgttcttgttgtcctagtgacatcatcagagaaagacagtgagtctctgtacaagagggtgaaaatcaacagactgatcaatatatttaagaatgaagcagtcattcctgcatttccagatctgcatttgtctcctgctgctatagtgaaggaattatcaacatactttccaaaattttcttcccaaactcgccttctcacccttccagcacctcatgagcttccacctcgtgaagcacaagaatatcagagacattatctgatcatcaatcatattggagccatccgtgcggagcatgatgattttgttattcgttttgcttctgcaatgaatcagctgttactgttgaagtcaactgatggttctgatgttgaatggagcaaagaagtcaaggggaacatgtatgatatgattgttgaaggttttcagctattaagcagatggactgcacgcatatgggaacaatgtgcttggaaattttctcgaccatgcaaagatgcatccccatcattctctgattatgaaaaggtagtacgatataattacagtgcagaggaaaggaaagcactggttgaacttgtgagctacataaagagtgttggatctatgatgcagcggtgtgatacactggttgctgatgctttatgggaaacaatacattctgaggtacaagattttgtccaaaacacattagctactatgttgcggactaccttcagaaagaagaaggacctctctaggattctttcagatatgcggaccctttcagctgattggatggctaatacaaacaagtcagaatctgagttacagtcctctcagcatggaggtgaagaaagcaaagcaaacatattttatccaagagcagttgccccaactgctgctcaggtgcactgcttgcagttcttaatatatgaggtggtttctggtggtaaccttaggaggccaggtggactcttcggcaatagtggctcagaaattccagttaatgatttaaaacagctggagacatttttttacaagcttggttttttccttcatattttagactactcagcaactgttgcaacattgacagatcttggtttcttatggtttagagaattctatttagagtcttcacgagtcattcagtttccaattgaatgctcccttccttggatgttggtggattgtgtacttgagtcaccgaattctggtcttctcgagagtgttctaatgccatttgacatctataatgattcagctcagcaagccttggtgttgctgaagcaacggtttttatacgatgaaattgaggctgaggtggatcattgttttgatatatttgttacaaaattatgtgaaaccattttcacatattacaaaagttgggcggcatgtgaattgcttgatccttcattcctctttgcttcggacaatgcagaaaagtatgccgtgcaacccataaggctcaatatgctgcttaaaatgactagagtgaagctgcttggaaggatgattaatttgcgaagtttgatcactgaacggatgaacaaggttttccgtgaaaatattgagtttttatttgatcgttttgagtgtcaggatctgtgtgccatagtggaattagagaagttgttggatgtcttaaaacattcccatgaactactgtctagagatctttctgtagactcttttagtctcatgttgaatgagatgcaagagaacatttcccttgtatcattttctagtcgattggcctcacagatttggtctgagatgcatagtgattttttgccaaatttcattctctgcaatactactcaacgttttatcagatcatcaagaacggttcctgttcaaaagccatctgtaccctcttctaagcctagtttctattgtggtactcaagatttgaattctgcccatcaaagttttgcacgactgcatagtggattctttggaacacctcacatgttttctattgttcgacttctgggatcccgatcattaccttggcttattagagctcttcttgatcacatatcaaacaagattactttgcttgaaccaatgattacaggattacaagattctttgccaaaatcaattgggcttcttcctttcgatggaggtgtgacaggttgtgtgagactcgttaaggagcatcttaactgggagacaaaatcagaactgaaagctgaggttcttcatggcataaaagagattggaagtgtattatattggatggggcttctagatattgtgttgagagaaaaggattctatggatttcatgcaaactgctccctggctgggcttgcttcctggagcagatggtcaaatagtaacttctcaagatggtggagacagccctgttgttagtttgtttaaatcaacagctgctgcaatggtttcataccctggctgtccatcacctacctctttccacattatgtcaaaacaagcagaagctgcagatcttttatacaaggctaacttgaacactggaagtgtgctggagtatgcacttgctttcgctagtgctgcgttggataaatattgtaataaatggagtgctgcacccaaaacgggcttcattgacatcacaatttctaaagatttctatcgaatatacagtggtctccaaattggatacttggaagaatctgcccaagtgccatcaaatagtcatgaaaggctgggagattcaattgcttgggggggctgcactataatttatttgcttgggcagcagctgcattttgagctgtttgacttttcatatcagatcctcaatatcgcagaagtggaggctgcatctgttatgcaaacacataagaactcacaatttgccgtgcagggatgggaagccttattggaagcaatgaaaaaagcaaggagattaaataaccatgtattttctatgcttaaagcacgttgcccccttgaagaaaagacagcttgtgctattaagcaaagtggtgctccaatacatcgtataaaatttgataacacagtttcagcatttgaaacactgccgcagaaaggttcttaaacgagtagtctagttgtagactgccagcaaattctgtgccttgttccctatacggtgtacatgtaactaagcggtgttgtattgtatgtaatagatactaagtacggtacgtatatgttcatgagccgagtttctatacagaggtagcaacaattttgtatttgataaaaaaaaaaatgtttgacataggtgttcgatttgaacaaactgttggacaatatttggcatgctcttatggaactaggtccaatctaagttctgaaccctacgaaaaaatacagaccaaaatattgttgtcagattacagctttagtggagctcagtcagttggttacaactgtcactagctattagttgtagttatcattggatttggcttggacaagattgtataaatacctttctcgacctctaacgagttttttctgctctttctcc

SEQ ID NO: 292 - DNA, 1922 bp, Glycine max
  misc_feature (1)..(1922): Glyma.07g205900.1
aactaaatatgcgggcaggctcacaggaccaaaacgagtatttagacagtttttttccatcaaaatgagtccaagaaagatggcaactgagtctgattttatagttcagtccttatagtaaaatcatgcaaaattaattgtagcagttgaacatttcattctttgctccaactttggtggaatccccaccattcagattcagttttcacctcgattccattccatgacaagcaacgctatgcaccccttcagaaacccaaaaccatgcctttcactgttccaccatcttttcagattcagaatcacacccaccaccaattccccctatccaacaatcccatcgaatcacttctcaactgattcttccacaacatacccgacaacaactaaaacgacaacctctgtttccatcgatgcaggttcttctaaccgcaaacccattagtctatggccagggatgttccattcccctgccatatacgctctctgggaagccagatcttccgttttcgaaaaccccgttctctccaatggcccctccgttctcaaaacaccctcccggagcaggacttgcattttctataacttctcagaagatcacatgcttcgcgagcagtataggaatccatggaatcacatcaggatgggcaagctcgtcgaggatttcgacgctcttgctggtaccgttgcgttcaagcattgttctaatgaagatggcacggcaagaccccttctattggtaactgcttctgttgacaagatggttcttaagaagccaatccatattgaagctgatttgaccattgtgggtgctgtttcctgggttggccggtcatccatggagattcaactggaattgactcagtccgctcaagggaatcccaatatctcaagctcacctgcacttgtagctaacttcacatttgtggctcgcgactccgccactggaaaagcagccccaatcaaccagatctcacctgaaagtgagcaagaaagattgctctgggaagaagcagaagagaggaacaaatttaggaaaagaatgaaacaagaacagaaacatggagagagtgaagaccctgctaggctcaaagcactactggccgaagggcgtatcttctgtgacatgccagcattggccaacagagatagtgtcctgatgaaggatacttgcctacagaactcttttatctgtcagccacagcaaagaaacatccatggtcgtatctttgggggattcttgatgagaagagcgtttgaacttgccttttcaactgcttatgcctttgctggtgcagcacctcatttcctagaagttgatcatgttgatttttttaaacctgtggacgttggaaatttccttcgtctcaagtcttgtgttctgtacacggaacttgacaacatagctgaacccctggtgaatgtggaagttgttgcacatgtgacaaagcctgagcaccgctcaagtgaggtatctaacagattctacttcacatttggtgttgatcctgtggccattaaaaatgggttgaggcttctacatgttgttcctgctacagaagaggaagcacggaaggtgcttgaacgcatggatgctgagaacctgagtttggttaaaaaagatggtaatctaaacgttgtcaaggagaacaagtgtacggagaaaacaaatctctgatatagcacctgtagaactttcttagtagttgtggattgaactacagagcgattttgaagggtttttttttttttttccattcacgattagaggtaaaaagataatagcttctcttggtggttcaatagaggaggcaacacaattctcaaacctttagaaatcaataataataatcgcaatttccttaatcaacgtgtcaaacacctcaagtcttcgaatagctatgagaaagagacaatgtttc

SEQ ID NO: 293 - DNA, 1709 bp, Glycine max
  misc_feature (1)..(1709): Glyma.02g259000.1
ttaattttgtgccatttttagctcttcacaagtgccaatccaatcccagccggtgcagaaaaaccatgaacacgccgtggcgtcggaattgaatgcgcgcgtgcgcacgtgtcaaacgcgacgacagttttcttctccaattcaatactactactactactattactataacatagacggcgtgttcttctttcaaaacccggttcatctttcttttttgttgctgccatattcctcccattttttttccttccttcaatctgctgcttcaatggaaggtttggcttctctcagggttccctttcagaccacccaattccactcttccagacccagaacctctattcttccatcccaagccatttttttccacaaaagaagctccttttcatccttttctgctagtgcccaggtggagtctaatgatggttcagctacagtagccacacctggtgaatctgtgacagaggctctgaaaactaaggagtgggaggtgggaatgttccaaaacgaggttgcagctagccaaggtataagaataaggagaagaccaccatctggaccccctttgcattatgtaggaccctttcaattcaggttgcagaatgagggaaatactccccggaacattttggaagagattgtgtggaacaaagacacagaagtctcgcatcttaaagaaagaaaacccctcggtgtgctgaagaaagctctcgaaaatgcacctcctgctagggattttattggtgctctaaaggcagccaacgaacgaactggactgccagggttgattgctgaagtgaagaaagcgtcaccaagtagaggtatcttgagagaagactttgatccagttgaaattgctaaagcttatgagaaaggtggagcagcatgtctaagtgttttgacagatgaaaagtattttaagggaagctttgaaaatcttgaggcaataagaatggctggcataaagtgccctttgttgtgcaaagaattcatcatagatgcatggcaactctactatgctcgaactaaaggtgcagatgcagtccttttaattgctgctgttttgcctgatcttgacatcaaatacatgatcaagatatgcaaattactgggattgactgcacttgttgaggttcatgatgagagggaatttgatcgtgttcttgcaattgaggggattgaacttattggcattaacaaccgtaatcttgaaacatttgagctggatatcagcatcacaaagaagcttcttgaaggagagcgaggcaaaataatccgtgagagaggcataactatggttggagaatctggtctgttcacccctgatgatattgcctatgttaaggaagctggtgttaaagctatattggttggagagtctattgtaaaacaaaatgatcctgggaagggaatcagcaatctctttggcaaagatatctctttgggttgaagtgagctatctttcttgagatatataggcattggacatgacagattttgataaggttcttgatttgatgctttcaacctttgcttgtaccaaattatcataaccttgtcaacaacagacttgtacctaaataaactttgaatgtttaataatactttgcaaataaatgatatcattttgggacgattgttggcgacaattcttctgtgtccttaactatgcatttcattttgaaaaattatatagtagatgttat

SEQ ID NO: 294 - DNA, 2819 bp, Glycine max
  misc_feature (1)..(2819): Glyma.07g072900.1
aacaaagattggaggtttctttctgtgttgttcacttgtttggtctctttctttcaaccttaacccttccaaaccaacacatataaaaatcaaccctctcttcttcttctctctccgcgggttgagttgaacttcaagaacctcataaaaccctttctctctctctctctctagatctgttcaaatccgaaaccatttccgctctaatttccaagagcaaaccctaatccgctctctctgtatgatactagatttcccctcctcaaaggcgtagttttgtgtcgatttgtaaattcattcggtagtttaggttagaatttttgtgtcaagtttttagggttttgaatcggtgagatgaatcacaacaacagcaacaatagagcgaggtaccctcccgggatgggacttgtgcgcgggggtttcaatccgaacctgagccagaacccgaaccagaaccagaacccgagcctgaaccagaatcatcacgcgttccaggctcggccgccgtaccaccaacagcaacaggcgcaatatgtgcagaggcatttgttgcagcagcagcagcaacagcagcagtggctgagaagggatgccaacgccgtcgacgaggttgagaagaccgtgcagtctgaagccgtcgattcgagttcccaagattggaaagcaagactaaagattccaccagctgatactcgctacaagacagaggatgtaacggcaactaaaggaaatgagtttgaggattattttctgaagcgtgagctgctcatgggaatatatgagaagggttttgaaaggccttctcccatccaagaagaaagcattccaattgctcttactggtagtgacattcttgctagggctaaaaatggaactggcaaaacagctgcattttgcattcctgcattggaaaaaattgatcaggacaataatgttattcaagttgttatactggtcccaacccgagaattggcattgcaaacttctcaagtatgcaaagaacttggaaagcacttgaaaattcaagttatggttacaacaggtggtaccagcttgaaagatgatataatgcgcttatatcaaccagttcatttactagttggaacaccaggaagaatattagatcttgccaagaaaggtgtttgtattctgaaagattgcgctatgcttgttatggatgaggccgataagcttctgtccccagagtttcaaccatctatagagcagctgattcattttcttcctacaacccgtcaaatcttgatgttttcagccacatttcctgttactgtaaaggatttcaaagataggtatcttcaaaagccttatgtcatcaatcttatggatgagctaactctgaagggtattacacaattttatgcattcgtggaagagagacagaaagtccactgcctaaatactctattttccaagctgcaaataaaccagtctatcatcttctgcaattcagtgaatcgggttgaactccttgccaagaaaatcacagaacttgggtattcatgtttctacattcatgcaaagatgttgcaagaccatcgtaacagagtgtttcatgatttccgcaatggtgcatgtcgaaatcttgtttgtactgatctttttactagaggaatagacattcaagcagttaacgttgttattaattttgattttcccaagaatgcagagacttatttgcacagggttggtcgttctgggaggtttgggcaccttggtttagcagtgaacttgattacctatgaggatcgctttaatctatataggattgaacaagaacttggaactgaaataaagcagattcccccacaaattgatcaggcaatttattgtcggtgattggctttaaataccagtgttgtgtttacagttgcggctaatagcagtggttagtgtgaccgtggctcaagtaggtgggtgagaggatctgctaagctagtggcaaattgtgtattattggaacctggcatgagaggatgcactgtcaaaaactgggtattattggacccattactgagtgctttcagattaattctggttttgggagccctgaaacattgttgagacctttaaaaagtttaatattggcttttatctgccagatagttattgggttcagtttgggtttctgttttccatttgcagatttattctgtcattacatgttttttgtattgtagttttataattgaatgttttagggatgatataccttggtatggacatgttccttccttatgctattatcctatggcgaatgctcatcggtgtcttcagggcactgactaaggaattcaaaatagtaacttttcattaaagtgtcatgaatatatctctattctgtactgtgatttcgaatgcattttcaatttggattttaataaaaactttatgttttggattccttaatcagtgccctagggttacttattagcaagacccttgtgctatcagtttaccattataggttctcttatagattttagattagttgtaggaatctcaacatttgctgctcatattatgccatatggttcttggtggtgccggtttatccacaattgcttgtcgctaggattttcatggccattgccgttgaagactcgaagtcctaaccaagcttctggagcctttcttttgatagagtcctttgtcttttttcaattgttaatttcatgaaactatgtagatatgggactgaaatggtatttctgctgggtatcttctgattttcatggattttcagcattgggtacaatgcacattttcaagtaaaaaaagaatgcacatttccaagcgtc

SEQ ID NO: 295 - DNA, 1289 bp, Glycine max
  misc_feature (1)..(1289): Glyma.11g234200.1
gcctttcaatttttgacctaagtgtgttgtttgtatcaattgatcatcttcctcttaccacaggtaacacttaacacataccatgcacaattacacacacctttgttctaaggtctaactaactctaaccatttcgactttcaagctagattgaggtctgaggatagtgatctttgtcttcgccaacaacatcgtccacttaaaaataaaaaagccctgaaatatctgaacttaaaagccacacttttatttgttgtgtgtgaggtttgatttgatgggaaaatatcttgaatctgcggcgaggttggaagagctatcgcggattgtgtcatctgctgcgaagcccaataggtcaaagggaacgctacccagatcgcccaaccgtgttgccactcctcgaattgcgaacccaattggtgttaaggtcgaacctgcgaaaaagatggaacctttggaatgtcggacacccctcgccaaggttgtcgcagattgctccaagcgctggttccaggacaccctcaaggaggccaaggctggggactctgccatgcaggttttggttggccaaatgtattactctggatatggtgttccaagggatcctcaaaaggggcatgtttggattagtaaagcatcaagaaatcgaaattcagtttggaaagtgtgcggtaaacggccaggatacagagcaagcgattctgattcatgaattggagaactaagatgaatcttttccttaatttgcaagtataactcgtgtttcttcaaagagattgaatttcaatttcaattctagagtatagtatatgtgaacttattgtaacatccaaagcataagtcaaattttgttaactgacaattgttcaacaatgatgtctctatttttgaattagttgttattgtgttgttcattgttcaggaagatgttatgatataataacttaaaacatcaactgtgtgccttattgtatgatttatttattatgcctaggtaagtattgtgttctgtacttcctttccccctttaacttcaaattgatatgctcctagcattgaccactctgcatctaggacttcgagagtaactcttgcacagacgctttaatccattctcctctattctatgtgagatcatagctacagatgttattttctaatagtctgatgtctgattttacatcacacttatattccggcaatcttttccagccatctttcctttagatgtgagttacttccacatgataacccttcccctcttgctctagttacttgcactgcctgaatcg

SEQ ID NO: 296 - DNA, 3791 bp, Glycine max
  misc_feature (1)..(3791): Glyma.05g117000.1
cgcctattcgggttattcccttggtcacgtcactgtgtgaaaagaagctgactggaaagagcgaaaagcgaagaaagtaagaacgaacgaaagcaaaaaattgtgtgctgattgagatactgataactccttcaacgtttccgcgtggatctctctctctgattcttcagtcttcgccatggcggagcgttcgtgtttcggattgggacctcgattagatcttcagcaattacaacttgaagcccagcataggtggttgcgccctgcagaaatatgtgaaattcttcgcaattatcagatgtttcaaatcacatcagaaccacctaacgggccaccaagtggttccctttttctatttgatcggaaggttttaaggtactttagaaaagatggacataattggagaaagaaaaaagatggaaagactgtgaaggaagctcatgaaaagttgaaggtgggaagtgttgacgtgttacactgctactatgcccatggagaagaaaatgaaaattttcagaggcgaagctattggatgcttgaaccggatatgatgcatatagtatttgttcactacttggatgttaaggttaacaaaaccaatgttggtggaaaaacatattctgacgaggttacatcagattcccagaagagcagttctttgtcatctggctttcccagaaattatggtagtgtgccttctggaagtacagattccatgagcccaacaagcactttgacatctttatgtgaagatgctgattcagaggatattcatcaagcaagttcaggattacactcctatcgtgaatcacaaaatctggggaatgatcgtccgatggataagattgatgctcgttcaaatagttcatatcctatgcatccgttttcaggtgatcatgggcagttaccagtttctggagcagaatatatcccacatgttctgggggataagtctagagctagtgatactacttacattgagggtcagagagcacagggcattgcatcttgggacaataccatggaacagtctgcaggagagtatgctgatccttctcttgtatcatctacaaccattccatcaagtgcagtgggaaacatccttgaagaaaaccatactgttcctggcaaacttttagggcgtaaaaatgccctaactgaagaggaaaggggctctcagcctgtccaatcaaattggcagattccttttgaagacaatacaggagaattgcctaattggggcttcacccaatcattgggtttggaatttggatctgattatggtgctagtttactgggggatgtaactaataatgcaggcccagaaattgttcctgagctgttcacttttaatggtgagttaaaagagcagtctgtgcaccaaaacttctcaaagctgtatacacatgggcaatctcaacctacactgaaatccaattctgaatatgaagttcctggtgaagcaagtatcaattatgccttgaccatgaggcgtggattattggatggagaggagagcctcaagaaggttgatagtttctctaggtggatgactaaagaatttgcaggtgtggatgatctgcatatgcagtcttcccctggtatttcatggagcacagatgagtgtggggatgtgatagatgatacctcattgaatctgtccctgtctcaagaccagctgtttagcataaatgatttttctcctaaatgggcttatgctgaatcagaaattgaggtgttgattgttggaacatttttgaagagtcaacctgtggtggcaaaatgtaactggtcctgtatgtttggggaagtggaggttcctgctgaggttttagctgatggaattctgtgctgtcaagctccacctcataagattggacgggttcccttctatgtaacatgttccaataggtttgcttgtagtgaagttcgggaatttgagtacagagagggctttgatagaaatatacaatttgcagattgttttaacaattcaactgaaatggtgcttcatttgcgactggtggggttactttctttaaactcagtacgcacttcaaatcaagtgtttgagggtgatatggataaaagaagcttaatattcaagcttatttcactgaaagaggaagaggaatattcaagtaaggaagagacaactgcagagatggatatatcaaaacacaagttgaaggagcttatgtttcacaagcaggttaaggagaagttgtactcatggcttcttcacaaagttactgaaactggtaaagggcctcttgtattagatgaagaagggcaaggcgtgttacacttaattgctgctcttggttatgattgggccataaatccaatcataactgctggagtcaatatcaacttccgtgatgtgaatggatggacagctctacactgggctgcattctgtggccgagagcgaacagttgctgtccttgtctccatgggtgcagcagctggagcatggacagatccatgtccagaatttccttcgggtagatcacctgcagatcttgcttctagcaaaggccataaaggaatctctggttttcttgctgagtcattattaactggccaccttgaatcactcacaatggatgaaaataaagatggtaggaaagaaacttcaggaacgaaagtagtgcaaacagcttcagagcgaactgcgacacctgtgctttatggtgatataccagatgctatctgccttaaggattctcttaatgctgtccgtaatgctacacaagctgctgatcgtatatatcaagtattcagaatgcagtcatttcagaggaagcagtttgctcagtatgaagatgatgaatttggattgtcagatcaacaagctctttctctcctagcttctaagacgtgcaaatctggtcaaggagagggtttagccaatgctgctgcaatacaaatacagaaaaagtttcgtggttggacgaagagaaaagaattcttgatcattcgccaaagaattgttaaaatccaggcccatgtaagaggtcaccaggtcagaaagcagtataaaccaatcatttggtccgtgggaatcctggaaaaggtcatattacgctggagacgcaaaggcagtggcttacgtggatttcgaccggctgccctgaacaaggtccctgaacaaccaagcgaatctccgaaagaggatgactatgattatctcaaggaaggaaggaagcagagtgaagtaaagttcaaaaaggccctttcacgggtgaagtccatggttcagtatccagaggcacgggctcaataccggcgggtgctaaatgtagttgaggacttccgtcaaaccaagggaggtaatttgaatttgataaattcggaagagacagttgatggtgtggaggatttgattgatattgacatgcttttagatgatgaaaatttcttacctatagcattcgattgattctctgctgttgctccacccacccccggtaaatagatggccagttggttttatttggcattggagagatcctaacatggtgtgctgctgtatatatatttatatttatatataatatacaatcagaactacttggatcataggtcttcctgttttcaagcaaaaaactaattagatccaagggtgggtttataaatagattatgaaacctagaatgcgttaaggtttgatagttcaaatacatgatagacatggtttaattttatatatgatgatttgtatatgacatgattatttttatttagatcgaaatatgcttttaattcttaaatttgtatcatttttt

SEQ ID NO: 297 - DNA, 2621 bp, Glycine max
  misc_feature (1)..(2621): Glyma.05g161000.1
atttgtggttcatatgaatcctgcactgtaaatatcatatcatagcaaccttaacttgacaacatattcctacgatcacttttcaaatggaagcgttttacacaactctctcctcccctgcttccacgtctgttctcaattttcagggctctgaattgcctagaagaaagctttgtaagaaatcttcacacactattttggcatcacctacgctgcctaaaccatttcttcagatttatggtagacctcagacattgctttataggtcaaccagactctcttctggagcacatagagtaacaatatcagctgaagctggcagacaaaattgggattttggaagatttgtaaaaacactgttcttcttcaatgggttcccatctcctgctaagttctttgattttctagttgagaaactatctgatccttccccaagtgaagtggttaacacaatgggaacttctgatattgtcctggtagctggagccactggtggcgttggtcgaagggtggttgacatattacggaagaaaggaattccagtccgagtattggttagaaatgaagagaaagcaagaaggatgttaggctcagatgttgatttggtcattggagacattacaaaagatagcactttgatccctgaatactttaaaggcgtgaagaaagtgattaatgctgcttctgtcattgttggccccaaggaaggagacactccagacagagcaaaatacagccaaggaattaagttctttgagccagagataaaaggtgactcaccagaaaaggtagagtacataggaatgagaaatttgatcaaggccgtgaaggacaatcttggacttcgaagagaaaagctattatttggatttgaaggcaataattacaggcagcttccttggggtgctttagatgatgtggtgatgggtggagttagtgaaagtacatttcaaattgacccaagtgggggtgaaaatggtggaccaactgggatttttaaaggtgttgtttctacagcaaacaatggtggctttacaagtatcagaactaagaatttctcagaacctgaaaatctttctgcatatgatggtttggagttccgcctaaaaggtgatgggcgtagatataaaattattgttcgcacaagcagtgattgggatgctcttggttacactgcaggttttgacactgagaaaggaaaatggcaatcaattcgagtgccattttcttccttgaggcctgtatttcgagcaagaactgtgtctgatgctccaccatttgatccaagcattgttgtatcattacagctcatgttcagcaagtttgagtatgatggtaaattaaatgaaacttttgtggaaggtccatttgagcttccagtgtctagcatacatgcatatataataaaggatccaataacccccaggtttgtacatgtgagctcagcaggagttacaagacccgaaaggcctggactagatctaagtaaacagcctcctgccgttcgattaaacaaggaactggattatatcctcacatttaaactaaagggcgaggatttacttagagaaagtggcattccctatgtaatcgtgaggccttgtgcattaactgaggagcctgctggtgccgatcttatttttgatcaaggagataatattacgggtaaaatatcaagggaagagattgctcttatgtgtgtagctgcgcttgatagcccttatgcatgtgacaaaacatttgaggtcaaaagtgtcattccatttagtgagccattcactgtggatccagcaaaccctcctccagaaaaggactatgacgtatattttaaaaatttaaaagaaggcattactgggaaggaagctctccaacaaaaccctgtttctgtttagttcggctatgaatattgcagatgtgagagtaccttgagagctgtacagttattgatctaaagagatctaaacttgacaaatctgtgatactacgtttttaaaccaagttagatatggcctttaccttacaatctgcatgtatatcctgtctccaaacatgagtccttttccttctagcaaataggaatgcaaagaatttttatattcagactgtaagaagatagaactatcgttttcttattcatgtaacagttttaggtttacatctctcagctgatgagaggaatgagaattacaggaagacatgcgtggagttagacaagcctaactgtttattattattattattgtcgaaatcaaaatccacacaccacacttttgaaagtaacttttttttttgtatcattcagaaaacaacaacaaaaactacatcctaggaaaggagacactgttttgaaagtgctttgttttgacactctgacgtctgtatattattgagaatatacagttctttagatgttttttggtatcacttctcaaataatattagacaactagtatttttactatcacaactagttttttttatatacagatttgttttgtatgttatcagaaaaaatgtgttgagagcatgccatgtgtagaggttgatgagcatccagtgctacagaatacagattgttcaggcacgtggattggttaccggaccgaggacagcgcttatac

SEQ ID NO: 298 - DNA, 1902 bp, Glycine max
  misc_feature (1)..(1902): Glyma.13g073900.1
ttcatgtcacaacgtttgaagcgcagtgccatgtctacacgtactcaaaatgtgacccgttcaatgagtgcttagcttgcactagttccatgaagtttcatcgaagcaactattctatttttaattattttttggttgaacctgaaattgacgactctgcctcttctgctaactgtggcatagccgtggacattttcttattcttggttaaacttaaatcagataaatacttccaatttcgagacttctcgttcacaccctttttcatcttcttttgttttttcttcatgaattttgttggtttggtctaacaaaatagtttttcatcatgggaaacgcttgtgcaaaaggaaaaccagttgctcatgtttcttcctccaatttctctggaagtaagaagcctgcaagtaagccaaagcagtattcaaattcttctgaacaacgatctgctccaacaacttcagaattaaatgttcccaaatccatctccagtaaccttaagtccttcagcttgaatgatctaaaagaggcaactaagaacttccggcgagaaaatttaatcggagagggaggatttgggcgtgtcttcaaaggatggattgatgagaacacatacggtcctacaaaaccaggcactggaattgtagtggccattaaaaatcttaagccagaaagcttccaaggccacaaggaatggcttcaagaagtgaattatcttgggatgcttcagcatgaaaatttggtgaaacttattggttattgcttggaaggtaaaaaccggcttctggtttatgagttcatgcaaaaaggaagtttggagaatcatttattcagaaaaggtgttcaacctatggcctgggttacaagggtcaacattgcaattggtgttgcaagaggattaacattcttacattccctggatcaaaatgttatctttcgtgatttaaaggcttccaatatcctacttgattcggacttcaatgcaaagctttcggatttcggcttggcaagagatggtcctactggagataatactcacgtttcaactagagttataggaactcaagggtatgctgcaccagagtatgttgctacaggtcatttgaccccaaggagtgatgtatacagctttggtgtagtcttgttagaattactaaccggaaggcgtgcggtggaagacgatggacctggattttcggaggagaccctggtggattgggcaaagccattcttaaatgataacagaagagttctgagaataatggatacaagattggggggtcaatactccaagaaaggagcacaagctgcagctgcacttgcattgcaatgccttaacactgaccccaaatttagaccacctatggtggaagttctagcagcattggaagcacttaattcctcaaattcatttacgcggacaccgaaacatgagagtcattcaaccaaaatatctggtggtccttcacaaaagtaaaatggaaatgcaaagtatatctgagctacttggcttgttctctttcactttttgggtgaatactttctatattcatccgtaaagaaaagaacataagaatactatgttatacccacaaatgatttgtcctttcatttctttgcatatgcgaagaattgccatctttgcgggttattgagtgtagagtatacattgtggtagcagctatagattcttattacattgtatgaaattttttagcttttaggatggctatatacaaatttggaaaaaaaaaattaaagttaataatggatatgtttaagcgggtatttttttcttcttcgtaagatgtctgctttggatatatagctttacgcttcaatgtttggactaattgtattatatcaatctgttggaatactacttgttgcgtatggaagagt

SEQ ID NO: 299 - DNA, 4702 bp, Glycine max
  misc_feature (1)..(4702): Glyma.01g168900.1
gtactcaaaaggagtcgcgttttgacgattcatcagaactttgaattctcatctcaagtggggagatgaaaaattgaaaacatggagaaaaagcaaaaaacaaaaaatatgccagtaaaaagattgagagagagagagagagagagagagaaaaattagtaagagttgggcacattcaaccaatccaaaacgagcatgtcgtctaccttcttcttactgagaggtcagagttccacgcactctctctctagcaatcgggatctctccgctttttgacacgaatttaccaacaaaacaaacagtgccttatttcatctccctgcgctctgcactccatgttagacttattagggttttctttctcccacctcatgttccgcaatcattgattctcttctcttctcttccttcgattcgatttgttctcgctatggagcaaccgcttcaaccgcagccggagaccgccgcggtcggcgctagggatttggagcagtcgcggctggtcggagttcccgtggcggagagagcgggaaacagttgcgcagcgaatttgcaggtgaccgtcgtggacggtggtgccgtttttaaacggaagcgcggtcggccggccaagggagcgccgaaagtggcgcctcctgtgaggcaacagcaggacgaggaggacgtttgttttatttgcttcgacggtggcagcctcgttctctgtgatcgccggggatgtccaaaagcgtatcatctcgcgtgtattaagcgagacgaagagttttttcgatcaaaggccaagtggaattgcggttggcatatatgtagcgtttgtcagaagtcgtcacattatatgtgctatacttgcccgtactctttgtgtaagggatgcacaaaagatgctgattttgtttgtgtcagagagaataaaggtttgtgcggaatatgcatgaggactataatgatgattgagaacatagcccagggaaataaggaaaagtgtgaagtggattttgatgacaaaagcagctgggagtatcttttcaaggtgtattggatgtatttgaaagggaagctatctttaacatttgatgagctccttcaagctaaaaatccatggaaaggtgctgctcctatgagttataagattcaaagtccccatgaactttatcatcttagagatgacaaaggttctggctcagagaactcctgtatagacatagaatcaaataatttgaagaacaagaagcccaagagacagccaaagcttcttgataagggtgattgcttggataggataacttctggtggtgacagtggtgtgtctttgcctgaatgcacaaaatgggcatcaaaggagcttctagagtttgttgcacatatgaaaaatggtgatacatctctcctgtctcaatttgatgtccagactctcttgctggagtatgcaaataaaaataatctccgtgatcctcaacagaagtcacaaattgtttgtgactctagacttttaaatttgtttggaaaaacacgtgttggccacattgaaatgctaaagctccttgagccccactttcttttaaaagacaatggccctgcagaaaatacttttggagcgggaattattaatgctgttgctagtgaaggggaggccattgacaattacaataaacagttgatgttggttgatgacaagagatgtaagacacataatccagatgcatatgctgctatagatgttcacaacattaacttgatctacatgcggcgaagtctgatggagaatctaactgaagatactgaaaagattcatgagaaggttgttggttcatttgtgcggataagaatatctagcaatgatcaaaaacaagatatgtatagacttgtccaagttgtaggtacaagcaaggttgccgaaccttacaaaattggcacaagaacaacagatattaagcttgaaattttaaacttaaacaggaaggaggtcatatccattgctgaaatttctaatcaggagttctctgaggatgaatgcaagcggttgcgtcagagtataaaatatgggctctcaaagagattgactgtgggagagattctaaacaaagcagtgacacttcaagcaattagagttaatgatttgctggaagctgagatattacggcttaatcatcttcgtgatagagcaagtgaaaaggggcatagaaaagagcttaaagaatatgtggagaagttgcagctactaaactctccggaggaacgtcaacgcaggcagcatgaaattccagatgtacactccgaccccaatttggattcaatgtttgagtctgatgaagatgatggagagtcagatgaaaggaagcaagatagcaatatattttcaaaatatcttgggtttgatagaaaagagaggggttctatttttccaagaatttcaaatggcgcctccaacgacatgggaggtaaaacacaagacttgcctgctacccgagaaccggttgggaatacatgcacagtgaagaataatatcaactgtgatgatacagctattgatgatagcactaatgcagttgtgaaatcagaagtgtccagtgttgcaccggacatttcatcaccgcttctctttactgggatgcagcagtcactgaatgattttttgaatgatagatcatggcattatcaggatccaactgggaagattcaaggacctttttctatgttgcagctatacaagtggaatgcaagtggatgtttccctccagatctccgaatatggagggtaggtgagaaacaagataactctatactgttaaccgatgcactaagtgggaagtgttccaaaaatgtgtcattgccattcaacagccaattgctctctttaggggtcagtgttacattggataataaagataatagtcaggatgctgggaagaatggaaagaatgaaatttctgcagatggccaaattatagaacagagcaaggaacaaaagccacaggtggataatacctctacccagtctgatggcaaagacgaacctgttaggagcaatggagggcatggccaactgcatgtatacccttcactactgccaactgccattcctgagaaattgaatgaggatccttctgataaattaaggaaaggccatgggattgtgggaaattccgaaaatagaaataatggctcgatcaggacatctgatgggcagagtaatagtgggcatagttatcagaagcaatcagatagtgaagagaattcagggaaatcttctggacagacctggagacaccctaatgtaaatagttcttccgattgcttggttaccatgtcagctcatgtttctggtacaaaaacatcaccgcataagctgggatttgatttgcataatcctccttcccctccggcagcatgtaatacatcttctggacagacctggagtcaccctaacgtaaatagttcttccaattgcttggttaacacatcagcccatgtttctgatacaaaatcatcaccacataagctgggatttgatttgcataatcctccttcccctccagcttgtaatacatcttctggacagacctggagacaccctgatataaatagttcttccaattgcttagttaccacaccagctcatgtttcagctacaaaaacatcaccacataagctgggatttgatttgcataatcctccttcccctccagcatgtaatacatctacatggcaggcaatcattggtgagcccaatgattttgatgaatccgtttcagatctgttggcagaagtggaagcaatggagtcacttggtggcttggaatctcccacttcaatcatgaaatgtggcgaggatttaactgaaggttctaaaaatgattgtctcagttttgttgcagagcttagcccaatgcttgatgcgggtaaaggtgatgcactgagctctactggtgatttaaacttaccatctcagccgacagcagcagaggaaccattacggcaagcagatgtacatcaccatcatcatcaaagaatttctgcggagcatccttcaagaagttctaaagttgaggtgggtacaaagaacggtgtttcaggtaatcaatgggattcaggctcagaaaattcacccattgttccatcccctggaaccttgggcctggctatagacaccacttggagacttgggttagagaatacacacttgggatggagtggaatagatcaaggaaatgcaaatgtgggttggggagtaggacagacggcagtgcaggaaaacaggagttctagttcatacacttctgcagtaactccaggctttggggatagccaaacaaaatatggcagtgatcgattttctgtgtccagagatcggggttttcaaggtcatagtagggaatcaggtttgagtagaagcagaattccatataacaggcaaccgtcatatggtgttggaaatggagcatcatataagcctctgcccaaagggcagcgagtttgtaaattttatgaaagtgggtattgtaagaagggagcatcctgtgattactggcacccatgattttagattccattagcactggtcacacttgttttttgtaatccttaacatatctgaagttggctctttccaattgttgtaatttaaccgacactattagtcaagtggcataattttttttatatgaaactactcttcttttatctatctgttttttttattgct

SEQ ID NO: 300 - DNA, 2275 bp, Glycine max
  misc_feature (1)..(2275): Glyma.12g174700.1
tataggccacataacataaggcttcattctcatacaagctcaccctccaatccactatcactcactctctcttctcctaccattatttctctctaccttgaacttccacaatacaactctctgcctataaacgctcttgtttaacgtgagaacttgggtgatcttttggagttgtaggagcccttacaccttgcagagtcatctcaacattcccaagggctcctactacgcaataacgccaagctcgatctcaaattaatatatcatttattcctcttaatcaaatattaaataagaaaagatgggagagatgtcaaacttccaattgggtgtgattggtgcactatttctctcggtggcttcttctgtctccattgtcatctgcaacaaagccttgatgagcaatcttggcttccctttcgccacaacgcttactagttggcatttgatggtcacattttgcacccttcatgcggctcaacgcttgaatctatttgtgtccaaatccgttgacttgaaaacggtcatgctttttggtattctaaatggcatttccattggatttctcaacttgagtcttggctttaattccattggattctaccagatgacaaaacttgcgatcataccattcactgtattattagaaactattttcttaaagaagcagttcagctcgaaaataaaattctctttatccctattacttgtgggagttggcattgcttctatcacagaccttcagctcaattttgtgggaaccattctttcccttctggcaatcataacgacatgtgttggccaaatcctgaccaacacaatacagaagaagcttaacgtctcttccacacagctgctctaccagtctgctccattccaagcagcaattctttttgtttcaggccctcttgtggatcagatgctcaccaagcaaaatgtctttgcctacaaatattctcctgtggtcttggcattcatcatcttgtcttgcttgatagctgtttctgtgaacttcagcacatttctggtcataggcaaaacatctcctgtaacatatcaagtgctaggccacctcaagacatgccttgttctaggatttggctacacattactgcatgaccctttcaccggaaggaacattcttggaatactaattgccgtttttgggatgggtttatactcttatttctgcactgaggagaacaaaaagaaacagttagctagtgatctcccactggcctctcaggtcaaagacaaagatagcttaccacttttggccgggaaaaacgtgggtaatcaaaacgaggaaaatcatgagactaagaaattaagcaaggattctgttatttgaaaggacaggctccatgtctttttaagatttcgtatattttgggtttctttcaatttctaggaaactagtaatgagtgtaaatcaaatttgtttaataagttttctgtaactttaagtcggtgcatttcatttacctaccatatattcattaaactgcaggaggaaattcaaatttcataaaattgtaatcccttttttgtgtcaatgaaaaggtagacatcaattattttgtgattcattgctatgttgttctcaataacaatcatagaaggtgcctgttgcattccattttgttattatcgttttttactaatctgaagactctgatgaaaattcaaatgttgtgtgcgtagtgagcgggctactcattctctggtgtcttagaaccatattattacagacaaataagatggcgacaatggatccttaattcagggatctcttgtatcaaaagtcctcttgatagtgggtctagacagcgtgtctcatggatgaagtagcggtgcaagtatttagaacatgtggactctaacatgaaaatactcgtagatgaaaatgactttcactcaaaggaaagattaccatgtggatgagactcgcacttgagggagagattcttggaatacaagtataaggtgaaatctcacattgagtacaaatgagaatgttgaacatcatataaatacagaaaaaacccataaacctgattttaggttaaaatgtgatgtcaagttcagttatatggttactcatgactcattagtgtaaatctgtatgatatttacccatctcagttcaacatcaaacatcaaaaaaaaatctcaagcattaaaaatttaatgggttcagctagattagcccaacaagtcccaaccattgttgatatttgatagaatctctatttctttttaatcgttgtttaag

SEQ ID NO: 301 - DNA, 1511 bp, Glycine max
  misc_feature (1)..(1511): Glyma.03g256800.1
gcacgataggaggcactacgctgtcgtttgcggtgttagaagacctagtcgggcgtgatggcgaagaagcgatcagccccgagtggcggtcgtcgggaaaaccgagccgaatcatcttcccgacggctcaactcagcttccggtcgcagaaaactcgttgcgttcttcatcgtatcgtccatcatcgctatcgtcacttatcgttatcgcttcagacaatcttctccttcgcaaggccttgtcacaactcatgctaattgccaacatatactcgccgaaaattcaaaagtatcaggaaattcgtctcagcgccattatacttatcctgtgcttggctacattactccctggaattctcgaggttatgaattggcaaaaaggttcaactctaagttcacacatttatcacccatttggtatgatctaaagagccaacagactagcttagttctagaggggagacataatgctgacagaggatggatctcagagcttaaaaaggcaggagaagctttgattttgcctagagttgttctggaagcatcaccagcagtgctgttgggaaaggaaaaacaaaggaacaaagccattaaccttatagtaacagagtgcaaggaaatgggatatgatggtattgttttggaatcttggtcaaggtgggcagcttatggtatcttgcatgatccaagcatgcggaatttggcattgcagtttgtaaaacagcttggagatgcactgcattctataagctcagagaaaattagtgggcagcagctgcagttggtctatgttataggttcaccttctgagaagttgcaagagcatgattttggtcctaaagatcttgagactttaagtgaagctgtggatggattctcgttaatgacatatgatttctctaatcctcataatcctggtcctaatgcacctttgaaatggattcaaattgttctacagctgcttctcggtacctctggcaatagagcccaaagccttgcccccaagatacttcttggtatcaacttctatggaaatgatttctccctttcaagggatgcagatgcagggggtggagctattattgggagagattacctggcacttttggagaagcactggcctgaactgcagtgggataagaatagtggggagcattttttcttttacactgacgacaaggatatcaggcatgtggtattttatccatctttgaagtcaatttctttgcggttagaggaagctcgttcatggggatgtggcatctcgatctgggaaattggccaaggtctggattatttttttgaccttctgtgatagcttgttatgtgtacttcttttgtggcccatgttaatgtttattcctacgtcgtaatgttgtgtattcagtataatcgaaacgtacttcagttaaattgggattttgtttttcagaaatctagtttgaggaaatgtgcagttagttcacttacgtgacagcatagaggatatttgagaacgtaataaaaatgcca

SEQ ID NO: 302 - DNA, 2599 bp, Glycine max
  misc_feature (1)..(2599): Glyma.13g084100.1 s
ttacttctcttcttcaacctcccctttccctaaactccttcttcactataacatcaccaattcgctaaactaaatataaaaaacttcgtatttcaaatccgacgccgtttttagatggattttgccagccatgatgaaccacctacctcgaatattcggccatagaaagaagcaagcctccgacaacatggacccgacgacaaagaacaagaagaagagtaagaagaagcagcagcccaaactcgagcgccgcaacgcctccaatcacttcgaatacgacgccggatcgtcgtgctcctggcgcggcggcgacgagaaggacgcttccgtctcgacgtcgtcgtcgtcgtcgtcgtcgttgcattgcacacgctcgatggacctctacgaccgcacgagcttccgaattgagggcgtggagggcgagttcgaccggatttgccgcagcctcggcctctccggccccgaggacttctccattccggccgccgcttgggaggccatgaagctccgctgctcctcggacctgcttcctcgccgccccaagcacggcggcgatgaattcgacgaagaggcgaaggagaaagaggaaattgaagttgtcgagagcgaggatcgagctagggttttggatgaatgtgttgtttctgctgagagcagtggttgctgtggtggaatcaagggttttcggcctccgatgctgaagccgccgccgggagttagggtttcggtggtggacgacgccacgtgttccacgtgggatttgatgcgggattttgcgccgaatggggaaggagaagggaaggatagttacgtggagttaaattcttttgatgatgaagatgatcatgagcgagtagagaaggaagaagaggaagatgaagaagatgaagaagaagaagaaggggaagttggtggagtgagggagaagagtgtagaagaggaaaatgcggcgaggattgcggaaattgtggatgatttttcagggttttctactccgaacgaagatgattcttcaagcactaccacgggtcctaggtctaacagtatatctcccaatgggagaatcaagcgtgttattaccgcgggtaattggcagaagggtgacctgttggggcggggttcgtttggttctgtttatgaagggatttctgaagatggattcttttttgctgtcaaagaagtgtcactacttgatcaagggaatcatggaaggcaaagtgtatatcaactggaacaggaaattgcacttttgagtcaatttgaacatgaaaatatagttcaatacattggcactgaaatggatgcatcaaatctgtatatctttattgagcttgtaaccaaaggttcccttcgaaacctttaccagagatataatcttcgagattctcaagtatctgcctatacaagacagattttgcatggcttaaagtatcttcatgagcgaaatattgttcacagggatattaaatgtgcaaatatattggtggatgcaaacggatctgttaagcttgcagattttggattggcaaaggcaaccaaattgaatgatgttaagtcatgcaagggaacagcattctggatggccccagaggttgtaaaagggaaaagcagaggttatgggcttccagctgatatatggagtctgggatgtactgtgttggagatgttaacgggcgaatttccatactctcacttagaatgtatgcaggctttgcttagaatcggaagaggtgagccacctcctgtgcctgattctctttcaagagatgcacaggattttatcatgcagtgtctaaaagttaatccagatgaacgtcccggtgctgctcaactcttaaaccatacctttgtccaaaggccactacattcccagtcctctggttccacatctccttatattagaaggggttaaacttgtcacctccaactatgaaacataatgaagttgctagagttggtctcgggtgcattgtcataacaatagttcattgtattgtgccttcagaattgcttgcttgtaacttaattttttatgcactgctttgaacctagcaatggatatggtactccagagagataactcaccctttggcttgaatgtcatatttgagaattatggtccacgtgttatctaattaatgtgataatttgtctctgttgtagcagtgtaaaatatcaacgtcaagctgtaacaggttgtcctccgagtcttcttccccttttgtttaattagcatatgaaagaattcttaggctaaacctttgggagcagtagtaacaagaggattagatatcatgttatttgtacatatcacctttattagtatgcaattgtttgtgtacatctttattttgttcccagtttcatctgttttcttttatcatttcacgcttttcgttctgttgcgtatttaaattttaaacaagcgatgtaataaatggggtgttctatgttttctatcattggtggcatatactgagtagcggttagtgtggaatattacaaggacaggtttgttctttggaacaatttatctgtaaccgaatgtttgtgtttaaagattttatactcaataaatgacttataaatctgaagt

SEQ ID NO: 303 - DNA, 2725 bp, Glycine max
  misc_feature (1)..(2725): Glyma.08g082500.1
agaaaagcaagtggcaaccaacattaatgtaagacacacacacgcacaagaccttagaccatattcattcactctaatttcttcttcatctgtcttgtttcaaagggaaaaattataagaaaaaagaaataaaaaaacataggctttggttcttctaacttgtaacttgttaagttccaaatcttcaaccactgagagagagacatcccctccgacattttctctattcttcaagcaaactcttccttcgtctcagatctctctctctctctctctagggtttccgtttctcttctgctatttatgatcactctctgacgcgcttctcctaccaaatcaagtgcttccgtctcttctccttcttctctgatttgaaggatttgtgtggctggagatggtggtttcggggccgatcacgccggggcaggtgtctttcttgctgggggttattccagtttttgtttcatggatatattcagagtacttggagtacaagaaaccctcatctcctcccaaagttcattcagatgtttgtcttgaagagttggggaaggatgcaattaaggaagatgatcgggccattttgctggaatcagggcttacaagatcagcatcagcaaaattccatccatcatctgtcaaattgaatttgattcggtcattttctacaataaatttttcatggggttctttctgttttctagctttatctttaaagatccttacctttttactttccatttgtaggtttttgaccatggatgattctttcttgttagaaaatcgagcaactttgagggcaatggctgaatttgggctgattctgttttatttctacatatgtgatcgaaccaacatacttggagattccaccaagagttatagtcgggatcttttcatcttcctctaccttcttctgattatagtttcagctttgagttctttgaagaaacataatgactcatcaacattttctggaaaaaatatactttaccttaaccgacatcaaacagaggagtggaaaggatggatgcaggtcctctttttaatgtatcattattttgctgcaacggagatatacaatgcaatacgtgttttcattgctgcatatgtttggatgactggatttggaaacttctcctattattatatcagaaaagattttagccttccacgttttgctcagatgatgtggcggcttaatttttttgtggccttctgttgtattgtgcttaacaatgactatatgctctactatatatgcccaatgcacacgcttttcactttgatggtgtatggagcattgggtatatataacaagtataatgaagttccctctgtgatggctgcaaagattttggcatgctttcttgtggtgatcttggtttgggaaatccctggattctttgacatattttggagcccatttgctttatttttgggttatactgatcctgcaaagcctgatctccctcgaatgcatgagtggcatttcagatctgggcttgatcgctacatctggataattggaatgatttatgcctactttcatccaaatgttgagaaatggatggaaaaattggaagagagtgagatcaagaggagagctaccatcaaaaccagcattgtttctgttgcattatttgttgggtacttgtggtatgaatacatatacaagctggataaggtctcatacaacaagctccacccctacacctcatggattccaattactgtatacatttgcttgaggaatttcagtcagcggcttcggaatttctctttaaccctctttgcgtggcttggcaagattactttggagacatacatttcccagtttcatatttggttaaggtctaacatgccaaacggacagcccaagtggcttctttctcttatcccggagtatcctatgctcaacttcatgctaacaactgctatatacgtctttgtatctcatcgactttttgaattaacaaatacactcaagacagtgttcatacctacgaaagacaatcgaaggctgctgcataattttattactggggttgtactttgcctttctctgtattgcattgcacttattcttcttctgattcctcattcaacggtttaaaattcaagccaccaaagagagattacatagacaataccctttgaattggctgtgctaaaaggaaactaggaaatgcggattaaaataagggtacatggaaatgtgggatctcttttggagcagtgtttctatagttgtgggaagtagtatcctcaatgacggcatcaaatatacgttgagtgttggtttgcattggaggttggcagatgaaaagggggattaaccccgaaggattttgaaccaattttctataaattcatttgtgctctcacacataaaacgagaaaaaggtaggatcgtcatacaaatccgtcgtcttggcttcgaagaaatccaagattcatttcattacccgttcctgttcaattttcattgtcattttttgactttttcgtctgtgaaggataaggaaatatatgtatattcatttatacaatcttttaccagaaacctgtcatacccttgtaacaatagttttgtttaatggctataagtgcaagtagtgttacttttttcttctgtttttttgggaggggttgaataaatcaccaatttagtcctctaactccaagtattactttctcttctaaatagctttaatgcaatatt

SEQ ID NO: 304 - DNA, 3158 bp, Glycine max
  misc_feature (1)..(3158): Glyma.20g130800.1
ggcgctgagattgagaaaagggaactctcacgaaactcaactctctctctctctctctgcctcaccctcttcgctcgcaccccatcccccatttcatttcagatcgaacccttctccctcctcgcactccctttcccattcgctgcggagttactcacacccacaccttgttaggctcacattcagactatagtcgtgaatgctgcggtggttcgtgttttctcagaactatggctagtccaactggagaattgacaagccataacgacagtaccgctgagccgatggcaactgaacaatgtgaattgtctgaaaaaacgcctcagataggatctgaaggtttagagagggaacaaaaggagcttcttaccgagttaaccagttttgttattgacgaaaaatcaaatcaagtttctgctgatgtgacggagaattctgttattcaactgcctgcaccgcctcaacatgactttgaaaagaattgccagactgtagaagggtcatgccttgaacaaagtaccgtcgaacaagtctctgttgatttatctaatgataaatctgaaaacaaatgcaagccattgtctgaaaatgttcaaagtgaacccgtagaatccattcctgccttcgtcgttgacgggcaaatgcaatccagtccagctcaagctaatatgagttctgtgaatgaattgttggatcaaccttctggagatgttgtgaacaatattaccaattgttcagaaaaaatgtctaatagcccaagtcattcgcaatcgaggcgcaagggtaaaaggaactctaaattattgaagaagaagtatatgctaaggtcgttaggaagcagtggcagagctttgcggtcaagaacaaaagaaaaacccaaggaacctgaaccaactagtaatttggttgatggtaatagtaatgatggagttaagaggaaaagtggtaggaagaagaaaaagagaagagaagagggaataactgatcagttttctagaatcagatctcacttaagatatttattaaatcgaataagctatgaaaacagcttgattgatgcttattctggtgagggctggaaaggatacagtatggaaaagttaaagcctgagaaggagcttcagcgggctaagtctgaaattcttcgacgcaaattgaaaattagggatctatttcgaaatttggattcattgtgtgctgaaggaaagtttccagaatctttgtttgattccgcaggagagattgacagtgaggatatattttgtgcaaaatgccagtccaaagagttgagcactaataatgatataattctttgtgatggtgtttgtgatcgtggatttcaccagctctgtttggatcctccgttgttaactgaagacattccacctggcgatgagggttggttatgcccaggatgtgattgcaaagatgactgcatggaccttgttaacgactcctttggaacaagtctttctattagtgacacctgggagagagtctttcctgaagcagcatcatttgctggaaataatatggataacaacttgggacttccttctgatgattctgatgatgatgattataatcctaatggttcagatgatgtgaaaattgaaggggatgagtcaagttctgatgaatccgagtatgcttctgcttctgagaaattggagggtggttcacatgaggatcaatacttgggccttccatctgaagattctgatgatggtgattatgatcctgatgctccagatgttgactgtaaggtcaatgaagaaagttcaagctctgatttcacatctgattccgaggatcttgctgctgcatttgaggataacacatcccctggacaggatggtggcatcaattctagcaagaaaaagggtaaagttggtaagctatctatggctgatgaactgtcatctttactagagccagattctggtcaagggggtcccactcctgtttctgggaaaagacatgtggaaaggttggactacaaaaagctgtatgaggagacgtaccacagtgatactagtgatgatgaagattggaatgacgcagctgctccaagtagaaaaaagaaactcactggcaatgtgactccagtgtcaccaaatgcaaatgcttcaaataattctatacatactcttaagagaaatgctcatcagaataaagttgaaaatacaaatagttcacccactaaatcccttgatggccgttcgaaatctggttccagggataaaaggtctggatcttcagcacacaaaagactaggagaagccgtagttcagagacttcacaaatcttttaaagaaaatcagtatccagatagaagcacaaaagaaagcctggcacaagaacttggacttacttatcagcaggttgccaaatggttcgacaatacacgttggagcttccggcattcatcacaaatggaaaccaattctggtagaaatgcttcaccggaagctaccgatggcagggctgaaaatgagggggagaagcaatgtgaatcaatgtctccggaggtcagtggaaaaaactctaaaaccacaagctctagaaaacggaagcatttgtcagaacccctatctgaagcacagctggatatcaatggcttagcaacaagttcaccaaatgttcatcaaacgcaagtaggcaataaaatgaagacaaggaaaaggaaatgatactttatgcaagagccctgtttaaccttttcctaaggcttcaaattacagtatccatccttttgtgagattgagatcccatgagatgatcggctaggatctcgatggatttgtttccatttaggaaggtaatcataaaatatgtgccattgtattttttaaaaatagctttccaggtattgatctggtgagttgttttagtgttgcctctcttgcaaacactaaactaaaaatagttcagttattagttatcagtttttaaatttttagatttttttgtttttttttgttttatttacagaaaccccattccttgttccaaatgatgttttttcctccttttaagggggtttactaacagtacaaaaaagaaaagaaaaaaaaacgatgaaaatagggggaaaatttatttttgtacctctggattcaatgccattactgtattaacctgcaggcaaccttagt

SEQ ID NO: 305 - DNA, 2506 bp, Glycine max
  misc_feature (1)..(2506): Glyma.02g014200.1
tgtactaaagctgcaagttggacagtagcaggcggaagctagaagtccaaaatcgaagaggttgagacttgcattgagaggagccttttttccccttaggtttttaaaattgcctttggaccttccttcccgctcgtttcacaatgaaatacgtgatcatcagcggcggagtggtcagtggcctcggcaagggcgtcaccgccagcagcataggcgtcgtgctcaaagcttgtggccttcgcgtcacttccatcaaaatcgatccgtacttgaacatcgacgctggcaccatgtctcccttcgagcacggtgaggttttcgttctcgacgacggcggagaggttgatttggatttgggaaattacgagcgcttcctcgatgtcacgcttaccaaagataacaacatcaccactggaaaaatttaccagtctgttcttgagaaggaacgtaaaggcgattatctcgggaaaactgttcaggtggtcccgcacatcactgatgctattaaagattggattgagtcggttgctgtgattcccgtggatggaaaggagggccctgcagatgtttgtgtgattgagctgggaggcactgtgggtgatattgaatctatgccgtttattgaggctctacggcaattgtcctttcaagtagggcctgataacttctgtctcatccatgttagcttgataccagtgttgggtgtagtgggcgagcaaaaaacaaagcctacacaacatagtgtcagggagctgcgagcattgggattgacacctcatcttttaacaagtcgctctgctgagcctcttctagaaagcactaaggaaaaactctcaaagttttgccatgttccagttgagaatattctgaacatccatgatgtaccaaacatttggcacattcccctgttactgagaaaccaaaatgctcaccattcaattctgcatcagcttaacttactcagccaagctacacctcctgatttacagcagtggacagagatggctgagacctatgataatcttactgaatctgtgaggattgcaatggtgggaaagtatgtgggtctaacagattcatatttatctgttgtaaaggctcttctgcatgcttgtgttgcacgctctttcaagccatcaattgactggattgcagcttctgaccttgaagatgacagtgcagaatcaacaccagaagcacatgctgcggcctggaagactttgaagagtgcagcttgtgttttggttcctgggggatttggagatcgtggtgtgagaggtatgatgctagctgccaaatatgcaagagaaaacaatattccttacctggggatttgcctgggaatgcaaatttctgtaattgagtttgctagatcagttttgggttgggaaagagcaaacagtgtagagtttgatgcccaaacaccaaatcctgttgtgattttcatgccagagggttcacggacacatatgggaagtaccatgaggcttggatctcggagaacactcttacagacatctaattgtatcacttccaagctgtacggcaattcagagtatgtggatgaacggcatcggcatagatacgaggtaaatccagatgttattggaactttagaggaagctggactaaaatttgttgggaaggatgaaagtggaaaacgaatggagatcttagagcttccaagtcatccattctatgtaggtgcacaattccatccagaattcaaatcacggccagcgagaccatctgctttgtttttaggtctcatattggccgcaacaggaaagttggaagcgtatattagtaggcagaatggaagttgatctacgatttgttactagaaggctcactcctacaatatttttctagggtaaactggtactccaaagggaagataattggggagagggaagggagtgggaactgaaggaggagataaggagaatcatggaatattgtacgtgtgcagctgcccatgcttctctagcttggttgccgagtaatattagttgcacctccacattcattgttttatcatcagaaaacctcacattaaaattcttttatattcatttaatagtaagaagatgcttaaaggaggttgcaaatactagtatgtcttcacctgtgaccgataatgaaatcaagcatggcagctagaatagtaaaattgtagggctcaaaagcgtttatctttccttagcttatatctgcacgtcttggccacactgttaaataaatttggggtatggtcaaacatttcccggtgggtgtagcttaccgtgggcgtaataccatgtattttcaataagatttcattttcgttatcttttcgtgatgcttttcattttatgttcgcttgttaggttttatactttcttattcaacaattgtaagtaaaaccaaaaggtcatatacatgtgtccaagtttatcttgtacttgtgttctctatatgttctattattttggaaggtttgttaatgataagttttggaagggac

SEQ ID NO: 306 - DNA, 4299 bp, Glycine max
  misc_feature (1)..(4299): Glyma.06g238700.1
aagtactcacgcagtttccttttctgtcttgcacccgtgctaaaattttcttctgctttacactgttccttgatgtgaaatatctgtttcttttgttttcctctcaattccaccacttccttcttgggttctgaaaatcatacactcctctgctttgaaacagagacccatttggctaaaaaagtctgcaaaggttaggactttcgtgggtggctgaggtttcaattgaatagtcactgttgagtgatggagttgagctacctgcaatgttaatggtaatgggatctttactttttgttaggtaccgtacctcactgcttctacgtgaactcaatgttctttttcacttccttttctgtgcttttttattttcaaatggctcctattgattgcttcgtcctcacgctgttgtctaatggtcccttttctacgtttgaccatcctctctcttcaattgggttgtttttttggattagtatttgcattcagatatagatttagtagtctttccttgttattcttcttttcccagtatttggttttggtgtgtgttggtgatatcaatagttttttttttttttttttcactttgttaattgtctttatgtatgcagttccaatttgtctattttgctgagtgttgaaaattttggaggttgggttcttctgtgttgtgaataagcactgaactttatagtgatgatttgaactttgaagctgaacacatacatatattatctctcttttggtttctgaaatggtgctgcaaagatgctaccctatggcttttgtgctatggggtttcttggcttgcttgctttgcttttctgtgggacttgaaacccttgccagatcctgtgacaagcatgatctaatggccctgaaggaatttgcaggcaatcttacaaaagggtctatcatcacagaatggtcagatgatgttgtctgctgcaaatggactggggtttattgtgatgatgtggttgatggagtagctgctagtagagtgtccaagttgattctacctggaatggacctcaacggcacgatttcaagttctttagcctatctagataagctaaaggagctcaatctttcgttcaatcgtctccaaggtgaattgtcttctgagttctctaatctgaagcagttacaagttcttgacttgagccacaatatgctatctggaccagttggtggggcattttccggtttgcaatccattcaaatactgaatatttctagcaattcatttgttggagacctcttccatttcgggggattacaacatcttagtgctctcaacataagcaacaattcattcaccggccagttcaattcacaaatttgcagcacctccaagggtattcatattcttgatatatccaaaaatcattttgctggtggtcttgaatggttgggcaactgtagcacgtctctccaagagttacatttggattccaatttattttctggccctcttcctgattctttgtattcaatgtcagccttggagcagctctcagtctctgtgaacaacctctctggtcaattaagcaaggagctaagtaacctctcaagcctaaaatctctaataatttctggaaaccatttttcagaggaactcccaaatgtttttgggaatcttttgaaccttgaacaactaataggaaacaccaattcattttctggatcattgccttccaccttggctttatgctcaaaactccgagtgcttgatcttcgaaataattctttgacaggttctgttgctcttaatttctctgggttgtctaatcttttcactttggatcttggtagcaatcattttaatggatcccttccaaattccttgtcctattgccatgaattgacaatgttaagccttgctaaaaatgaattaactggccaaatccccgagagctatgcaaacctcacttcccttttgactctgtctttgtcaaacaatagctttgagaacttatctggggcactttatgtactgcagcagtgcaaaaatctcaccactcttgtcctcacaaagaatttccatggtgaggaaattccagaaaaattaacagcaagcttcaagagccttgtggttttagcacttggaaattgtggtctcaaaggccgtattcctgcctggctattgaattgcccgaaattggaagttcttgatttgtcttggaaccatttgaaaggtagtgtcccttcttggattggtcagatggaccgtttgttctacttggatttgtcaaataattctcttacaggagaaataccaaaaggtttgacacagctgaggggcctcatatcctccaattatcatatatcaagtctctttgcatctgctgctattcctctctatgtcaagagaaacaagagtgctagtgggctgcaatataaccatgcctcaagtttccctccttcaatatacttgagcaataacagattaagtggaacaatatggcctgaaattggtcgtttaaaagaacttcatatcttggatttaagcaggaacaacatcaccggcaccattcctagctctatttcagagatgaagaatttggaaacattagatttatcttataatagtctcgttggaactattcctccatcatttaacagcctcacattcttgtctaagttcagtgtagcatataaccacttatggggattaattccaattggaggacaattttcaagtttcccaaattcaagttttgagggcaactgggggctttgtggggaaatatttcatcattgtaacgagaaagatgtgggcttgagggccaaccatgtgggaaaatttagtaaaagcaatatccttggcataacaattgggttaggagttgggcttgcactgcttcttgctgttattctgctaagagtgtcaaagagggacgaggataagccagttgataacattgatgaggagcttagctgtccaaacaggaggcccgaagcactcacttcttcaaaattggtgttttttaagaattcagattgcaaggatctcacagttgaagatttgttaaaatccactggcaattttaaccaagaaaatataattggttgtggtgggtttggtcttgtctacaaggggaatcttccaaatggcacaaaggtagctatcaagaaactttcagggtactgtggtcaggtagaacgtgaattccaagctgaagtggaggcactctcaagagctcaacataagaaccttgtttcacttaaaggttattgccagcatttcagtgacagattattaatttactcctacttggagaatggaagccttgactattggctgcatgagagtgaagatggaaattcagctctaaaatgggatgcaagactcaagattgccaaaggtgcagctcatggattagcttatttgcacaaggagtgtgaaccacatatcgtgcatcgtgatattaaatccagcaacatacttttggatgataaattcaaagcttatttggctgactttggtctctcaaggctacttcaaccttatgatacccatgtttcaacagatttagtaggaactttaggatatattcctccagaatacagtcaggtactgaaagcaactttcaagggtgatatttatagctttggtgttgttcttgttgagcttcttactggtcgaaggccggtagaagtcatcatcgggcaacgtagcaggaatctagtgtcttgggtgttgcagataaaatctgagaatagggagcaggaaatttttgattcagtcatttggcacaaggataatgagaaacagctcttagaggtactagctattgcttgtaaatgtatagatgaagatccaaggcagagaccccatattgaattagttgtttcatggcttgataatgtaggatttgatggctctgagcagtcatcattttaaatctctgcattcatgccatatacatggttttggttggtgtatctttgagacagtatatacttgtaaatcatgctattatggtggtggtgggatatttttgataaggctacacttatttggcttttagtccaaattagttctatactgatggtttaatctgtactacaaagggtactttttaactatcaaatcgtatccaacactggcttttagcagccttgtcaactgttatcaagtagcattaatgaaaaaactgtctacataaattgccaaaatctaaacctaaaccattttggtactttctgcttgaatatattgtatcaatatatttaagtttgtgactcagtttcttttctgtgtttatttagtatatgcctcgttttttt

SEQ ID NO: 307 - DNA, 3453 bp, Glycine max
  misc_feature (1)..(3453): Glyma.10g205500.1
cacactctacccttaattactatgtcttaactcacactcactcacaccaaacactctcactctttctccacctttcttgctttcttctccttcctccatttcctatcttcattcctaccaatgactgacatcactgatgatattgctgaggaaatctccttccagagcttcgatgatgactgcaggttgcttggtaatctcctcaatgacattctccagcgtgaagttggcaccaacttgcttgacaagatcgaaaggactcgagtccttgctcagagtggttgtaatatgaggcaggcgggtattgtaaacatggcagagatgcttgagaagcagttggcttcggagttatcaaagatgacactagaagaagctttcacccttgctcgtgccttcagccattatcttactttgatgggtatagctgagacccaccatagggttcgtaaaggagggaatatggcacaaattgcaaaatcttgcgatgatatatttaaccagctggtgcagggtggagtccccccagaagaactttatgacacagtctgcaagcaggaggttgaaattgttctcactgctcatcccacacagattaaccgtcgaaccttacagtttaaacacattagaattgctcatcttttggattacaatgatcgacctgatcttagcactgaagatcgagaaatggtgattgaagatctggtgagagagataacttcaatatggcagacagatgagcttaggcgccagaaacccactccagttgatgaagctagagctggtttcaatattgtggagcagtcactctggaaagctgtccctcattatttacgtcgtgtcagcaatgcattaaagaagcatacaggaaagccacttcctttgacttgcactcccataaagtttggatcttggatgggaggtgatagagatggaaacccaaatgtgacagcaaaggtcacaaaagatgtttcacttctatctagatggatggcgattgacctctatattcgggaagtggatagcctcagatttgagctatccatgaaccagtgcagtgataggttgtcaagattggcacatgaaattctagaagctaagcatgagaatcgccgtgagaattggaatcagtctgcgaatagaagtctcacacttccaacacaacttccagctagagctcatttaccttctattgctgaaaatggtgaatctcggcatcccagactagacattccagcacctgattacatgcaatccaatcacaaggatggtggggtttctgtaagttcaactacatcaaaacttgccaatcccaatactcgattaccaggaacaagttcagcaaattccagtgcttcttcagctgcacttggtcaaaagaaattgtatgcagaatcccagacaggaaagtccacttttcaaaagcttttggagccaatgcttcctcaacttcctggaattgctccttatagaattgtcctggggaatgttaaggataagcttgagaaaagtcgtagacggttagaaattcttcttgaggatgttgcatgtgactatgatcctttggattactatgaaacatctgatcagcttttggaacctctgctcctctgttatgaatctctgcaatcgtgtggatctggggtgctagctgatggtcgacttgctgatctgattcgtagagttgctacctttggaatggtgttaatgaagcttgacttgcgtcaggaatctgggagacatgcagaagcacttgatgcaataacacagtacttagatatgggtacttacagtgaatgggatgaagaaaagaagttggacttcttaacaagagaacttaaagggaagaggcctcttgttcctgttagtatagaggttcatcctgatgttaaagaagtcttggatacattccgaattgccgctgaactggggagtgattcacttggagcttatgtgatctctatggcctcaaatgcaagtgatgtccttgcagtagagcttttacagaaggatgcacggcttgctgctattggggagttgggaaaagcatgtcctggtggaacgttgcgggttgtccctctgtttgaaactgtgaaagacctgagaggagctggttcagttatccggaaacttttatcaatagactggtaccatgaacacatcattaagaaccataatggacatcaagaggttatggttggatattctgattctggtaaagatgctggtcgctttactgctgcttgggaactttacaaagctcaggaggatgttgtagctgcttgcaatgattatggaataaaggttactctattccatggtcgtggaggcagtattggtcgtggtggtggcccaacatatctggctattcagtcccaaccccctggctctgtgatgggaacgcttcggtctactgagcagggagagatggtagaggctaagtttgggttgccacagatagctgttagacaacttgagatatacacaacagctgtactacttgcaacccttcgtccacctatcccaccccgagaagaaaaatggcgtaatgtcatggaagagatctcaaacatcagttgtcagtgttaccgcaatgtagtgtatgaaaatccagaattcctggcctacttccatgaagccacaccagaggcagaacttggcttccttaacataggtagccgccctacaagaaggaagagctcagtaggaatcggacaccttcgtgcaattccctggttatttgcatggacacaaacaagattcgttcttccagcttggcttggagtcggagcaggtttaaaaggagcttgcgagaaaggttacaccgaagagctaaaagccatgtacaaagaatggcccttctttcaaagtaccatagatcttattgagatggttttggggaaagctgacattcctatagccaagcactatgatgaagtccttgtgtcaaaggagaggcaagagcttggccatgaactaagaagtgagctcatgacagctgaaaagtttgtcatggttattagtgggcacgagaaacttcagcagaataataggagcttgaggaggctaattgagaatagacttcccttccttaatcccttgaacatgttgcaggtggagatactcaagaggttaagacgtgatgatgacaaccgtaagatcagagatgctttgcttatcaccataaatgggattgctgcagggatgaagaatacaggttgaccttgcttctcaaggactatattgtacaagccttccacaattcacatatgttcacccttgttttataataggtttgctaaggaaagattatcatagccataatggtgaatggtttgttctgtactcagatatactgttatataagaatgtgatgcaaaataattaagtttttccagcattttggttcctacttctttatcatgaatttcttgtacttcttgcttaatttgggag

SEQ ID NO: 308 - DNA, 2505 bp, Glycine max
  misc_feature (1)..(2505): Glyma.13g139100.1
ttccgttgacctaggggcattaacgtcaaatcgaatcacgccgcaaaacatcttatgcaaaccccccttcttcttcgtcttcctcctcctcctttgatctgcaactgcaacagcaagcacaaacatcaaacagagtcattgttattgtaacgtaaaatcacatggagaaggaagctttgaaggaccaaattgaaactccaaagcactgaacgaactcaattgaaaccctagcacagagtcatacatagatagtagcgtggatagcagtgtgtgatgcggtgatcgcgatcacgatgaaaaatgcaaacggcttgatttcgacgacgtcgtctaatacggcacagtcacaatccactggcctcaagacgtatttcaagactcacgaaggccggtacaagctttattacgataagacttacccttccactcttcttcactacgctcatggcaaaaccgtttctcaggttactctggcacatctcaaggacaagccggtgccttcgacgccgactgggcagtcttcaactttcagtgccaccagtggggtaaggtcagcggcggtgagattgtggggaggaagcaatggaggccggtctcttagttttgttggaggcaatggtaccagcaagaaccttggggggaactctaggattggttcgattggtgcttctagttcaagtaatgcaacgtctaattcaaattttgatgggaaaggaacttacttgatcttcaatgtcggggatgcaatttttataagtgatttgaattcacaagacaaggatcctgtaaagtctatccacttcagtaattcaaatcctatgtgccatgcatttgatcaggattctaaggatgggcatgatttgatcattggcttgaataccggcgatgtttactcagtgtcactgagacaacaattacaggatgttggtaaaaagcttgttggggcccagcattacaacaaagatggttctgtcaataacagtcattgtacttgtattgcttgggttcctggaggtgatggtgcctttgttgtaggtcatgctgatgggaatttgtatgtatatgaaaagaacagagatggtgctggtgattcttcattcacggttgtcaaagatcaaacacaattttctgtttcccatgcacgttacagtaagagtaatccaatagccagatggcatatatgccagggttcaattgacagtatttctttctcaactgatgggacttacatagctactgttggacgagatggttatttacgagtatttgattacttaaaagaacaacttatatgtggtgggaaaagttattatggtgctttgttatgttgtgcttggagcatggatggaaagtatattttgacggggggagaggatgatttagttcaagtttggagtatggaagatcgcaaggttgtggcatggggtgaggggcacaactcatgggtcagcggtgtggcttttgattcatattggtcatcacctaattcaaatgacaatgaagagactgttagatatcgatttggttccgttggtcaggacacacaattgcttctatgggacctggaaatggatgagattgtggtacccttgcgacgtccttctggtggatccccaacttacagtgctggaagccagtcttcccaatgggacagtgttgtcccgttgggtaccttgcagcctgctcctagtatgctggatgttctgaaaatctctccactcgttacccaccgtgttcatactgaaccactctcaggcttgatatttacccaggaatctgtacttactgcctgtcgggaggggcacataaaaatctggattagacctgcagctgctgagagccaatcaagcaacgctgaaactctcttatctaccagccttaaggagaagccttcaattttgagtaaggttggcaattctagccacagacaatgactaagatcttgctaataattgaaagggtattcactttgaagacccttttaataatttcttcaatgtccttcttagtctccctctatcccttttcacagggctaaaagccatgcaatttacttctcactggtgccttgagtggcctctggttttaaatcgagcctaatggcgctgcgtgatcaatgtagttgacctcacctagtgggttaaagttataattattgtttttaatatggtttatctttttatccggttgattacctagataaattttttattctggtaaagataaaccaactggtttcattttgtatatattgggtgtgatgagcgaatactttcgggcctccaaccgtaagtaaaaaacggctgtcattacgcattggtatatgcctcataacaggaaataacgtgaaattggttcttggagatccgtactttggcatgggtacagcccattatttagtctgttgacttcaattgtgtgggtgttttctccctatcacatcaacgtgggtaagttacatagttggggagtgtactggtaaaattctttgggtctgagaattct

SEQ ID NO: 309 - DNA, 4096 bp, Glycine max
  misc_feature (1)..(4096): Glyma.06g061600.1
ttcacttcacttgggagttgggacaagtgaggaagtcaagagttggttctttaccccatatacccctccctatcacgccagaaacatttcatttctcttccagcaaatcgaaacggctcgcgttgttcacagtcacactctcactctcacactctctcactcacactcacactcacaccattgtatagaagattagagagagagaaccctaaactaaaaccctaaaattccattgcagcaagcaaaggcattgatcgatctgcatgggtcacgtaggttccagcaaggacggcaccgaggctgggccttccgccgccgcgatgggcatcgacgacgacgaagacatcgacctcggcgacgtcgatctcgacccgaccaacgccgaaatcctcgaagagctcggtgaagacattgtgaaatactggtgcaagaaagcgtcgatgctcttcttcaacgagtacggtctgatcagccaccagatcaactcctttaaccacttcatccacacaggcctccaaaaaaccttcgaatccttcggagacctagtcgtaacgcccgggttcgacccttccaagaagggagaaaacgaacacttccgttacgcctccgttaagttcggcaatgtgaagctcgataaacctatgttctggggcggtgaagggaacgcgcaggagtttaagatgcttcccagacacgcgagaatccagaggatgacctacgcttccaaagtcaaaatccaagttaaagttcaggtgtatgttccgaagaaggtacggagtgataagttcaagactgggaaagcggaattccttgacagggaggttatgaaggaagacgagagggaaatcatcattgggagattgccagtcatggtcaagtctgatttatgctggatgaaagaggcggagaaggaggatgatgaatttgaccatggaggttattttatcgttaagggtgcagagaagacttttattgcacaggagcaactgtatttaaagaggctatgggttatgaatagtccaggttggatgattgcctacaagtcacagatgaagagaaacaggatggttattaaactggtaggaaattccaggggtgaagaagtggagaatggggacatgtctcttgctgtatattttttgtctgttgaggttcctgtgtgggtactgtttttcgctctcggtgtctcatctgacaaagagattgtagatctcattggttgtggcaatgatgatgtcagaattcagaatattctctttgcatctgttcgggatgctgatgagaaatgtggagcatttcgaagaggtaggcatgcagttcaatatttagaaaaatgtgtaaaaagtgttcaatttccaccttcggagtctatgcaggagtgccttgaaatgtatgtcttccctggaattagtggtttgaatagaaaggcgcgcttccttgcatatatggtgaaaggtctcttgctggcttatactggccgccgaaaatgcgacaacagggatgattttcgaaataagaggcttgaattggccagtgagcttcttgaccgtgagttgaaagtgcacattgcacatgcccggaagcgaatggcaaaagctttgcagagagacctttatggagatagggatgtacgcccaattgagcattatctcgacgcgtccataattacaaatggcttgcaaagggcattttcaacaggagcgtggtctcatccatacaagaggatggaaaggatctcaggtgtggttgcaaatgttgggcgcactaatcccttacaaaccatggctgagttaagaagagcgaggcagcaggtccagtacacaggaaaagttggggatgctagatatccgcatccttctcactggggcaaggtttgtttcctctctaccccagatggtgaaaattgtggactagtaaaaaatttggctgtcacaggattagtaagtactgatgtatcggcagtatctgaatatatactgcctaaattgctggattgtggaatggaagaacttgttgatgatacttccactcatcttgggaacaaggacaaagttctcctaaatggcgattgggttggagtgtgtcctgattccagttcatttgtggcagagctacgaagcagaagacgtagaaatgaactgcctcatcaggtggaaatcaagagagaccaatctcaacatgaagtgcgcatatactcggatgcaggaaggattctacgtcctcttttggtggttggtaatctactcaagattaaaggatttaaatcagactgtaactctttccagtctctattggataaaggtgtgattgagctgattggaccggaagaagaggaagactgttgtacagcctggggtgttgagtatttatttggaaaagaaggaaaacgatctgtaaagtacactcattgtgaacttgatatgtcattcttattgggtttaagctgttcacttgtaccatttgctaatcatgaccatgcgaggagggtactctaccagtctcagaagcactcctcacaggcaattggcttttctacaacaaacccgaacattagagttgatactttgtctcaccagttacactatccccaaaagcccctttttcgaacaatggcttcagattgtcttggaaaaccagacaattcacttggtcaaaataaaataagtaaaatacctccaaaggcagaattctataatgggcagaatgcaattgtggctgttaatgtacatctgggatacaatcaagaggattcccttgtgatgaaccgtgcttcactgcagcgtggtatgttcaggtctgagcacataaggagttacaaatctgaaatcgataataaggaatcttcagataagaagcgaaaacctgaagacattgtaaattttgcaaagctacaaagtaaaattggccgagttgatagccttgatgatgatggctttccatatgttggtgctaatttgcagagcggtgatattattattgggaagggtgctgaatctggtgcagacaatagtgtaaagttaaagcacactgaaaggggttatgtgcaaaaggttgtgctgtcttcaaatgacgaagggaaaaattttgctgtggtttcattaagacaggttcgaagtcccgttcttggagacaagttctccagtatgcatggacaaaagggagttttgggatttctggagtctcaggaaaattttcctttcacaagacaaggcattgttcctgatattgtcataaatccacatgcatttccctcacgacaaactcctgggcaactcctagaggctgctttaggaaaggggattgcttgtggtggcatactgagacaagctacgcctttctccacaccttctgttgatgccattactgaacagcttcacagagctgggttttcaagatggggaaatgagagggtatacaatggaaggactggtgagatggttcgatcactcatttttatgggaccaacattttaccaacgtctgcaccatatgtctgaagacaaagtgaaattccggaacactggtccagttcacccgttgacccgacagcctgtagctgacagaaaacgatttggaggtatcaagttcggtgagatggagcgtgattgcctaatagctcatggtgcatcagccaacctgtatgaacgcctgtttacactcagtgactcctctcagattcatatctgcagcaaatgcaaaaatgttgcaaatgtgatcttgcggcctgtctctggtggccggaaaatacgaggaccttattgccgccactgtgaatctgcggatgacattgtggtggctcatgtcccgtatggagcaaagttattatgccaggagctctttagcatgggcataaatcttaaatttgaaacccaactttgctagacaaacactaatggtctcttttgttcatttctcccttaaatgaatttcagtgtagatattactttcgttcgccgatgtttctttgaatgcctggcaattagaagtactggatctcttttatcttgttactgatgcatgtttctctattatttacgggctagttagtgtatccttgtgaaaagttgaagacaagaaatttaaaaatgattattaac

SEQ ID NO: 310 - DNA, 2185 bp, Glycine max
  misc_feature (1)..(2185): Glyma.10g025000.1
tccatatttccacagaataggaaatagcgtaatttacgtgtgctcctttattcagttcctcttctcacactggtcaaggtcactcgtctcttctccttctccccctctctatttctgtttctctcccgattttcgcttcccaatttcttccctctcatatcatcttagctagaaattaagatagtctatcttgatcatgggtttcaattctgtctatagaaacttgcaggagatatttccgcaggttgatcccaggctactgagggctgtagctattgaacacccaaaggatgctgatctagcagctggaatagttcttgcggaagtcatcccgttcatgtccaaaaaactacctgctgcaattcctccacagcacaatgaccatggagccccactagatgttgaagttgaaagtgaggaagaaggcaataggttgaggcactgtcagcgtgttgatgacgtaaatgtggggccttcctctactttgtcaaatggctgtaattcaaaagatgatactgaaaaatttcttggaatggatgatattaaggagctagatatttttcagaatgctgaagataacttcattggggaaaccttgaacgagattgctcaggagatgtcaaatggctttattcaggaggaagataatgaaaattttgagagacaacctgtggattttgattgtgaaaatttgatatcttcagctgatgattatgatgtcaccccaagtcacagattggaagaatgcgaaacttacttgattgagttagaaagttctgaagctcaagaagtttgtcatgttcaaggcgatacattaaattctaaagatagtcttcaatcagaattggatgctggttcttctactgctggtggcaatactagtgatgttgaaaatgataatggtgcaaagagtgcaggtagccaatatagtcaagtatccaggattgatctgcttgaggaaatcattgatgaggcaaaaaccaacaagaaaacgttgttttcatcaatggaatctcttatcaacttaatgagagaagtggaagttcaggagaaagctgcagagcaggctaatatggaagctgctactggagggtctaatattctggccaggatagaagaatacaaaacaatgctggtgcaagctaaagaagcaaatgacatgcatgcaggagaagtttatggggaaaaagcaattcttgcaactgaactgaaggaacttcaatcacgcttgctcggcttgtctgatgaaagggacaagtctcttgcaattcttgatgagatgcgccacattcttgaagaacgactagctgcagcagaagaatcaaggaaagcagctgagcaacaaaagctggaaaaggaggaatctgcacgaaaggctcttgttgaacaggagagactggtggagatggtagtacatgaatcacaaagactacagcaggaggcagaagagaattcaaagttacaggaattcctaattgatcgtgggcgggttgttgatatgttgcaaggggaaatctctgttatttgtcaggatattaagcttctaaaagagaaatttgatgctaatcttccgttgagtaaatccttcacctcaagccagactagttgcaagttagcttcatcaggttcttcccacaaaacattggcatctgatgcgggttctgaccatagtgagtcatctggaatacgtaagacaagctggacaacctcaattgaaagcctttcttccaagattgggcatgacgaggaaaaatccaaagctgatcacaatgctcttcttgatgatgggtgggatatttttgagaaagatgcagaactgaattccggagtttgctgactttttattctgctgagagggggaaacatggggagttaatgctaatgtttatacaacaaaataaaccttagaatccttcgatgatttttctttatgtttcagtagcatactagcatgcatacaatttttatgtagtcctcttggggagttaatgctaatgtttatacaacaaaataaaccttagaatccttcgatgatttttctttatgtttcagtagcatactaagtagcatactagcatgcatacaatttttatgtagtcctcttgagtttgggttctcattgttttccagattttgtatagaaaacgtcacagcaaattacttgatttcttctttctcatctgta

SEQ ID NO: 311 - DNA, 2068 bp, Glycine max
  misc_feature (1)..(2068): Glyma.11g141100.1
gagagtctggcgttttgcgtgtctgctgtctaaagatggagttagactgttgaataacagatggagggacaatgacgtctgaatcaacgcatctccaccgtccacgtctcagaatcaggttcagttccggtccctcttgcaaaccaacgatctgccactgtgatgtaactcggaaagttaacgaagaaccattcggtggaaatcggcgacgaacgaagatcatcatcaacaacctcacaccctcatcaattcaattcaattcttcgccctataaaatcaaaatccgttacatcacttttcacatccattcctaacctccccaacctgacaattacacgtttctttcagagaagctgacatgccttcagtttacatgggagataggatggataattctaactcgagcttgagttctaattctaaagaaagcagtgttgttgttaatgggaaagaaacgtacaaaaaacttctggttgcatcacggcctaaaggctttgcacagagaaattatgaacaccttgtgtcattaacccatggtgactttggaagcagtgctgtgggacgtgtcacgttttttctactaaaacttgctgcattagaaaccgtgaggagattctccaggagtaaatgtccgtgtgtatggcgaggcctacagggtctccaaatccttgtctatccaccattcaaatggattcagaggtgggcacccttcaggggtttggtgaaaagcatgcaggtactatcaagacctctattagtcctttctattgcaaccgtctttactgatcaaccacaatgtagtgatggaacctcagattgtgttgcttcgcatgattctgaagcatccgccgaactatctccagcagaggctaatttgaatacaagtcattgtgagatagatcctgaagttttagaatatgaaaactggttgactctactcaatcaagagctggaaaatcaagggattagtttgccagaaagaatcaatgatgatgagctccacagattttacacagcttctaataatgactcttcatgcttccttacctcaatcaagaagacaataagttggcgggacagttacagatttctttcaggggaagagctggaaacgtggtcaaatatggttttctggcatggatctgatttttcgcacagaccttgcctcattgtacggcttgggatagcctgtcgctctttggcatctgaagatagacttcaatttgctcaggcagttatatcacaggtagaatacggagtcttgcacttggttgatgcaagcaaccctcaaattacagtattggtggattgtgaagggttatctccattgagaattcctatgaaaatgttgagatcttgttcctcccttctgctagaacactttcctaatcgtcttggttgtttgtttatcatccgacttccagcaattgttcgtgttattgcccagacttttattcaggttttaaagccatctactaggaagaagttgaagttaggaggagaggtatatcggaaggtactttatgacaattttccgaccctaccatcatatcttggaggcagctgctcttgcatgagatgttctaaaattggcaactgggatattctgcaacctcatgcaactgggaccagccggattgatagagaggaggatatcagtgacaataggggtttgccatcactgcatcaatctaatgaattagatggccaccaaaccagcaattctgaccagctgttgagaaaggctgtcataagtattctcgtattttgggttttcatagctcttggtgctggaatttacgatcctggtagtcttcatttacccccataacctaagattgggaaaattagttttgtttccctagttgaataaatttttagaggacacctctagtttgagttgtgtttttgaattaggagctagtgtggtgttatccaaagttcagaacagtaaaggtgcactgtttcagattctttaaatatatagatctccggttatggcttgaacaaatgcattgtaaaatcgtttttggttttataaattatatcaaatattccattttaccgc

SEQ ID NO: 312 - DNA, 1910 bp, Glycine max
  misc_feature (1)..(1910): Glyma.05g046400.1
ggtacccagtaggccgcagcaagtgccattttattttgccctacctcctcgattctagggtttcaacaatggcgctgttccttctctacgaatccgcttcgggctacagcctgttcgaggttcacggcgtcgatgaaatcggccagaacaccgaagcggttcggaactccgtttcggacctcaacaggttcggcaaagtcgttaagcttcgctccttcaaccctttcacttccgctctcgatgctctcaaacagtgcaacgccgtctccgaaggcatattaactgatgagctgaggactgtcttggagaccaacttgcctaaagtgaaggaaggtaagaagtccaagttcagtttaggtgtgtccgatcctaagattggttcccagatatctgaagtgactaagattccttgccaaagtaatgagtttgtgagtgaacttcttcgtggtgtgcgattccattttgatacgtttgttggtgatctcaagtctggagatttggaaaaggcacaacttggtctgggacatagttacagcagggcaaaggtgaagtttaatgttaaccgtgtagacaacatggttattcaagctatcttccttcttgatacacttgacaaggatattaattcattctccatgagagtcagagagtggtattcttggcattttcctgagctggtgaaaattgtaaatgataattatctgtatgccaaagttgcaaaatttattgaggataaggcaaagttggctgaagacacgattccaggcttaactgacatagttggagatgaagataaagcaaaggagattgtggaagctgccaaagcctccatgggacaggatttgtccccagtggacttaatcaatgtccatcaatttgcacagagggtaatggacctatctgagtacagaaagaacttatatgattacctggttgctaaaatgaatgatattgcaccaaatttggccactttaattggtgaagttgttggtgctcgtttgatttcccatgctggtagcctcacaaatttggcaaagtgcccctcttcaactcttcaaattcttggtgcggagaaggctttgttcagggcattaaaaacaagaggaaacactcccaaatatggtttgatattccactcttcttttattggtcgggcatctgccaaaaataagggcagaatggctcgatatcttgcaaacaaatgctcaattgcatcacggattgactgctttgctgaaaggggtactactgtttttggggagaaactgcgtgagcaagttgaggaacgacttgacttttatgacaagggagttgcccctcgcaagaacatagatgtcatgcaggctgctattgaaagtgctgaaaacaaagatacagagatggaaacagaagcacctgccgaagtttcaggcaagaaaaccaaaaagaagaaacaaaaagctgctgctgctgaaggtgatgacatggctgtagatacaaatggtgatgctgtggaggatcataaatcagagaagaagaaaaagaaagaaaagaggaaattggaacaggagatggaggtcgacgatcaggctgaagatgatggtgctaatggggtcacaagtgaacaagaaggaacagtgaaaaagaagaagaataaaaaggatagtaacggagaagctttggaggctggtggagagtctaagaagaagaaaaagaaatcaaaaaagaaggatacggagtaaactatgatgtattgcagctttaactgttgaaatcgaatcttttatgttatagttttggacaatgttaaatttgctttgtactttaccagttgctgcaccagtataaactttatgttgacttgtcatttggcatacaaattttgtcctagcaattttccgcgtaatttcagtattggaaaagtctatctc

SEQ ID NO: 313 - DNA, 2033 bp, Glycine max
  misc_feature (1)..(2033): Glyma.15g125700.1
ctaatttttgttcaaacgccaatattggaagaacaaattatgggtctatccacaaaaaaagtgtgttttcatactttgcaaaacgtgcaattaagtcaaacttagtggctaagtttgcccagtacacgcagattctcttttcttttctttttgtctattcctttggctaattgatttttgtttccttttcatggtggcagtggcagacatcctccattcttttcttgcttttaaatttgcctttcccttttgttgtgtatataagggggtaaatattgggaaaatttacattaattggttacattggttatcgaataaactatccctcacactttactccaacttggaattgtttgaattgcagtgaacacttggaagcagataatgaaccaacgcactccacgccttcaagtcttcaacctccactgtcaagcgagaaaactcacctagagaaatgacaagagttcagcttcctcttctacctggtcttcctgatgatcttgctgttacttgtttgattcgagtaccccggattgagcacaggaaactacatttagtttgcaagagatggcgccgccttctgtctgaagacttcttttattcactcaggaaaagtcttggaatggcagaagagtggttatatgtcatcaaagcagaccgtgctggaagaatttcagtgcatgcttttgatcccatctaccaactatggcaacctcttccccctgttcctggagattttcctgaagcaatgtggtttggtagtgcagttcttagtggtttccatttgtacttatttggcggagtagatctggaaggatctagatctattagatgtgttattttctacaatgcctgtacaaataaatggcatagggcacccgatatgctgcagaaacgtaatctgtttcgttcttgtgtgataaataattgtctttatgtgtctggtggggaacttgaaggaattcaaatgactcgatctgctgaagtttatgaccccagccaaaacaggtggaatttaatatcagagatgagcacatccatggtgcctttatttggtgttgttcacaatggaacatggtttttcaagggaaatgcaattgggagtggtaattccatgtgtgaagcctattcacctgaaactgatacttggaccgtagttactaatggaatggtcaatggatgggataaagattgtatctctctgaatggacaactctatgcattaggttgcccggatggatgcaagctcactgtatatgatagagcaacagattcatggagaaagtttattgatagcaagcttcatgtgggtaaatttccaactctagtagctgctgcacctgtttcccttaatggaaagctctgcattatccgccacaatatgaacatcagtttagttgacgtttcaagtcctaacaaccaagtggaaagcaatcctcgggacctttgggaaaatattgctggaaaaggtcatcacattcgcaggtctttagttagaaagttatggtcaactatagcaaggcgtggttgttcaaagagttgcattgtttgctgtcaggtgctacaagcctgagaagaaaatcccacctgataatattagttatgcagttaaggagattgttctctttggaaattaactgaaatatgtttgtccactttcttgcaatggacatgtaggagaaattatgcttcttcctttaaaatgaggttagttgtagatttttggcaatagaacgaagtctttcttatacaatcttgaatagggggcagatgttgtatatgctatttcgctctaaggcagggccttttcctttgttactggatataaagttttttaggctattagagatatagtaagttgaagattagcagtaagtttgttagcatatataaagatttgatgcactttgaactcacctttctcattatcaatacattctactttcgttctatatttttccccagttatctcttctgtcttagggctgaaccatgaattataatagcggatgtacatgatttattagaactaa

SEQ ID NO: 314 - DNA, 4005 bp, Glycine max
  misc_feature (1)..(4005): Glyma.10g188600.1
atttttttgttttgtttgggttatgcctttgctgcttgttgctgctcaaccctttctttgtttctctcacttgctctttctctctctaaaatctcaggactctcagattgtgccttttttttttcttttctcaaacctttggtctttgattccaattccagttggcttctaagaagagtgttagtgaagtatttattgatcagggaatggctgggactgtgagtgaggaatctggggtgggaaagtctgtggagagtatttcaactgggcagcgttgtcaatccggggaagcattggcagagtggcggtcttctgagcaggtggagaatggaatcgcgtccacttctcccccttactgggacactgatgacgaagatgatggaccaaaaccgtcggcgttatatggaagatatacatggaagatagaaaagttttctcaaattaccaaaagggaacttcgcagtagtgcatttgaggttggcggttacaaatggtatattttaatctatcctcaaggctgtgatgtttgcaatcatctctcactgtttctgtgtgtagctaatcatgacaaacttcttccaggatggagtcattttgcacaatttacaatagctgtggtcaataaagatcccaagaaatcaaaatattctgatacattgcatcgattttggaagaaggagcatgactggggatggaaaaagtttatggaactgtctaaggtgtatgatggatttgttgactcttcggacaatctaataataaaggctcaagttcaagtcataagggagaaatcagacaggcctttccgttgccttgattgtcagtataggagggaacttgttagagtatatttgacaaatgtagaacaaatttgtcggcgttttgtggaggagagaagaagcaagcttgggaagttgatagaggataaagctaggtggtcaagcttctttactttctggcgggaaattgaccaaacttctaggcaccacatgtctagggagaagacagatgtaattttgaaagtagttgtaaaacacttctttatagagaaagaagttacttctactttggtaatggattccttgtttagtggattgaaggctcttgagggccagaccaagagtaaaaaaggtagggtgaagttgttggatgctgaagaaataccagcaccaatagttcatgtcgagaaagatatgtttgtattggtggatgatgttttactgctacttgaaagggctgcaatagaaccactgtctcctaaagatgagaagtgtcctcaaaaccgtacaaaggatggaaattctggagaggatttcaataaagattctatagagcgtgatgaaaggcgcctgacagaattgggtcgtaggactttggaaatatttgtccttgcccatatattcagtaataaaattgaggttgcctatcaggaagctgttgctctgaaaagacaagaagaactcatccgtgaagaagaggctgcatggcaagctgaaagtgatcaaaaaacaaaacgtgggagtgagagggaaaagaagtccaagaaaaaacaggccaaacaaaaacgtaacaaccgaaaaggaaaggacaaagagagggaggagaggactgctgcgtcggtacctgacaagaaccaagacaatgctgttgatgagaaaaatgattctaaaatggaggaagctcaagctgtgtctgaaaagcctgatgccatggaagatgtttctgatatgtctgactctgtagatggagttgctgaaacgcttcagctcgattcagaagatagagatgctagtcctgttaattgggataccgatgcatcagaagttaatcctccaactaaggctagaaacaatggcatagatgatgtttcaaccatgcaaaatggaatctctgagaaaaggagcagttcagtgatagatgatagttcttcaacatgttctactgattctttgccgtcagtagtcatgaatgacccccacaagggaaactccttttcaaattataaagtccaaaagtcacctagcagaggtaagaaccgaggcaaaacatcatctgatgtgggtagttggacaaatgaaatagatagtcagccatctggttctgcagcagatgctggggattttaatgatgagtctggaaatggtaagattggcaaatctgagtccgaggttgctgtaatctccttacaagatcggttgaagtgggctgagaagcatgttgtcagaaaggaagaggaggttctttcacttaataaactgggcatcaaagacctggttgagacaaagagacctgttgacaacgaaagcctacagaaagagaagatatcaactgtgccatcctcgcctattagtcctcccagaaacttgtcctctgttcaaatgaagttagaacacaagactagtgctactgtagatcctgttcatgtcaggaaaacatcttcaagtggctcccaacagactgataaagatccatcttcaccttttacttctgcatcaccggttccagctgtgtccaaaactgagattcaaaagccttcaactgcaagactatctgaaagatctgtggcacaagtgcctatgatgtcaagaccttcaagtgctcctttagttcctggtcccaggccaactgctcctgttgttgtttctatggttcaaacagctcctctacttgcacgctcagtgagtgcaactggccggttgggtcctgatccctcaccagctactcatagtcatgttcctcaatcctacagaaatgcaatgatggggaaccctgtggcctcaactgctgctagtctggcccattccagctcctcaagttcaggagtgatcccatcacctggctattctcaaccatcttccttcgtgtcatcaatgtttttatcccagagctctgacagattggacactagtgctggtcagtctggtgttccttttaccatgattacacaggatgttttacagaatggtccccagtggattgagagttctcaaagggaatcgagcagaagcatgcactatgatcaaccctctgggcttaatgatgttcaaaatcatgacttgtacaggccagtacacagtagatccatgggcaatatgtcaaccgagttcccagcctgcacatctgggcgtcagaaccaagggtatttggtggatgagttcccacacattgatatcataaatgacctgcttgatgatgaacaaggtattgggaagacggccaaggcaagttcagcattccagtctctgaataatggaccacagttgctgaatcgacagttcacttttcctggggatctgggtgcagatgatgatttgggatcttcaaccagttcttgcaggtttgagcgatcacaaagttaccatcatgaccatagattccaaggagggtatgacttgtctggtgggcattatgattcactgagggattatattcaaccgatgagtagtgtgcctggcgtcaatgggcaggttgatgggttgattcgaaaccaatggcaggtggccggttccgatgtgttgtatttaggcatgagaaacacagagaatggtagttatgcatactatccagattactcaaatatggcatgtggtgtcaatggttatactgttttcaggccatcaagtggtccttagagggttacgaagcgtacccacaaatgagtggtcactaacaaatgtaatgtatttgaggaaattgttgggtctttttagattggagagaggctgtaatctctcttataagaaaaacattttgtaaagagtgtttttgagttatttgcttccagctttattttttttttcttccagttcatgtctttgtctttgccttcctgggattatggataaatcttgatgaggtttgaacacttttgtcttaataacttgagcttgccatgcatcccctcattttagatgcatgctgcagaattccaaaaacaaggctataaccctatgagccatggatattaataggacagttaccctatatattttgaaaacaatgggt

SEQ ID NO: 315 - DNA, 4099 bp, Glycine max
  misc_feature (1)..(4099): Glyma.16g039900.1
agaaccgtaggataaggaacctgagagaaaggcatatatcgaaacccgccatttaaaatccccccctgaaagtggcaaacccttgcagttttggtcttccctcgctttcttcagagagagagcaagcgatggcgagtgatccgatgcaacaagtggccctaatcctgggcccggactcagcccagctggaatccctaatctcccaattgatgtcttcgtccaaccaccaccgctcccaggcggagtccttattcaacctctgcaagcaggcccgcccggaggccctccttttgggcctggcccatctcctccactcctccccgaaccccgagagccgcaccatgtccgccatcctcctccgccgccacctcacgcgccaccacgactccttcctctggcccctcctctcccctcccgcccgctcctccctccactccctcctcctctcctccctccacaacgagcctctcaaatcaatcaccaagaagctctgcgacaccgtctcagagcttgccgccgccaccctccccgacgacgccgccgcctggcccgacctcctccccctcctcttccagtgggtcacctcccccgacccgaggctccaagaaatctcgctcttgatattcgctcaattggctcattacatcggccaaaccctactccctcaaatttccactctccactccgtcttcctccgctccctccactcctccaccccctccgacgtccgcatcgccgccctcgctgccgccatcaacttcatccaatgcctcaccaactcctccgacagagaccgcttccaggacctcctccctctcatgatgcagaccctcacggaggcactgaactccggccaggaggccgtcgctcaggaggctctcgagcttctcatcgagctcgccggcactgagccgcgcttcctccggcgacaaatcgccgatgtcgtcggttccatgctgcaggtggcagaggccgaggccttggaggaaggaacacggcacttggcgattgaatttgtcgttactctcgctgaggcgagggagcgtgctcctggaatgatgaggaagctgccacagtttgtgagaaagctttttggtgtgttgatgaatttgttgcttgatatcgaggatgatcctgcgtggcacggtgcagaggatgaggaagaggacgcgggcgagacgagtaactatggctttgggcaggagtgcttggataggctctcgatttcactcggcgggaacaccattgtgccggttgcctctgagctgttgcccacctacttgtctgctcctgagtgggagaagcaccatgctgccctcattgcgcttgcccaaattgcagagggttgttcgaaggttatgataaagaatctggagcaggtattgtcaatgattttaaattcatttcacgatcctcaccctcgagtgcaatgggcagctataaatgcaattgggcagttgtccacggatttggggccagacttgcaggttaaatttcaccacttagtgctgccggctttggctggagctatggatgattttcaaaatccaagagtacaggctcatgctgcttctgcagtgctaaatttcactgagaattgtacctcagatatcctaacaccttacttagatgggattgtgagcaaacttttggtactcctgcagaatgggaagcaaatggttcaagaaggagcattgacagccttagcatctgttgctgattcttcacaggagcaatttcagaagtattatgatgctgtgatgccatatttaaaagctattctggtgaatgcaaacgataagtctaatcgtatgcttcgagccaaagcaatggagtgcattagtttggtaggaatggctgttggaaaggagaagttcagggatgatgccaaacaggtcatggatgtcttgatgtcactgcaacaatctcaactggatgctgatgatccaactgcaagttacatgctacaagcatgggcgcggctttgcaagtgccttgggcaggattttctcccatacatgggttttgtcatgcctcctttgctccagtctgcgcaacttaagcccgatgtgaccattacatcagcggattctgatactgaatttgatgaagaagatgacagcattgaaacaatcacacttggggataaaaggattggcattaagactagtgtcttggaggagaaggctaccgcttgtaacatgctatgttgctatgctgatgagttgaaggaaggatttttcccttggattgaccaggttgctttcacattggttcctcttcttaaattttacttccacgaagaagttaggaaggctgcagtttcagccatgccagaactgttgtcctcggcaaaatcagctgtagagaagggacagtcgcaaggtcgtgataagacttacgtaaaacagttgtctgattatataataccaaatttggtggaggctttacacaaggagccagaagtagaaatttgtgcaagcatgttggacgcattgaatgaatgcatacaggtctctgaatcacatctagatgaaaagcaagttcggagcattgttgatgagattaaacaagtccttacggccagttcatcaagaaaacatgaaagagcagagagggccaaagaagaggactttgatgctgaagaaagagaactactcaaagaagaaaatgagcaagaagaggaactttttgatcaagttggtgattgcttgggaactttgataaagacattcagggcatctttcttgcctttctttgatgatctgtcctcatacctaactcctatgtttggtaaagacaaaacctcagaggaaaggagaattgccatttgtatatttgatgatgttgctgagcatggtcgtgaagctgctcttaaatattatgattcttttcttccattcttactagaagcttgcaatgatgaatatccagatgttcgacaggctgctgtttatggtgttggtgtttgtgctgagtttggtggatctgttttcaaaccccttgttggagaggcactttcaaggttagatgctgtgataaggcatccaaatgcactacattctgataacataatggcatatgacaatgctgtttcagctcttggaaaaatatgccaattccatcgtgatagcataaatgcagcacaggttgttcctgcctggctaaattgcttgcctataaaaggtgatttaattgaagccaaggttgtgcatgaccaactttgttcaatggttgaaagatcggatagagaacttataggtcccaacaatcaatatctttccaaaattgttgcagtttttgccgagattttatgtgcgggaaataatctggcaaacgaacagactgttagtcggatgattaatttattgaggcagcttcaacagactttaccaccttctacacttgcttcaacctggtcatccttgcagcctcagcagcagcttgcacttcagtccatcctatcatcctagtagttttggatcgtcaccttcagaagatgcgtgtctattgtcatgggatgtcatagttaccttttcagaagctgctttgtcaggtcaaattcattcctttggcatcttcggagtgtctttttttgaagcagctgtgtctggttcgtgtttcatgattgttgaatccatacttggttttgcaagccaggacttgagtaaggctttgttgcagaggcagagcagtgtcgagttggttggataggaaacagttttggtgtgaaatgtgcatactgtgttatagtcagaaggaattctcaaatgaacagtggctcgatcctgtctgtggatgatggggacgaggcgtgatcctgagtcatgcacgactcaggtaaatcgcatagcattcttttgtttattttgagttgtaacagttttgatgggtcatttcttttggaagttggaaacatattgtcatagtttaattaatttgtatatctgcatgtttctttccctgcgctttttccttcctacgtaccctaagttaggatagggaaaatagaagcgagtagggtagaaagatggaggtggcgaaaaaattaacataacttttaggttctttggagacggcaagcataacacctttcgca

What is claimed is:

1. An elite soybean plant, or a part thereof, comprising an introgression or genetic modification resulting in the elite soybean plant or a part thereof an increased expression of: an miRNA selected from SEQ ID NOs: 12, 25 and 34 and/or the gene of SEQ ID NO: 196, wherein compared to the host soybean plant or a part thereof used to produce the elite soybean plant or a part thereof, the elite soybean plant or a part thereof exhibits an increased resistance to an SCN infection.

2. The elite soybean plant, or a part thereof, of claim 1, wherein said elite soybean plant or a part thereof exhibits an increased resistance to a *Heterodera glycines* infection.

3. The elite soybean plant, or a part thereof, of claim 1, wherein said part is selected from the group consisting of a seed, endosperm, an ovule, and a pollen.

4. The elite soybean plant, or a part thereof, of claim 1, wherein said elite soybean plant is transgenic.

5. The elite soybean plant, or part thereof, of claim 1, wherein said elite soybean plant comprises:
   i) one or more heterologous nucleic acid sequences encoding one or more miRNAs selected from SEQ ID NOs: 12, 25 and 34, or
   ii) one or more native nucleic acid sequences encoding one or more miRNAs selected from SEQ ID NOs: 12, 25 and 34 operably linked to one or more heterologous promoters.

6. The elite soybean plant, or part thereof, of claim 1, wherein said elite soybean plant comprises:
   i) a heterologous nucleic acid sequence encoding the gene of SEQ ID NO: 196, or
   ii) a native nucleic acid sequence encoding the gene of SEQ ID NO: 196 operably linked to a heterologous promoter.

7. The elite soybean plant, or part thereof, of claim 1, wherein said elite soybean plant comprises:
   i) one or more heterologous nucleic acid sequences encoding one or more miRNAs selected from SEQ ID NOs: 12, 25 and 34 and a heterologous nucleic acid sequence encoding the gene of SEQ ID NO: 196; or
   ii) one or more heterologous promoters operably linked to one or more native nucleic acid sequences encoding one or more miRNAs selected from SEQ ID NOs: 12, 25 and 34 and a heterologous promoter operably linked to a native nucleic acid sequence encoding the gene of SEQ ID NO: 196.

8. A method for producing an elite soybean plant, or a part thereof comprising introgressing or genetically modifying a host soybean plant resulting in the elite soybean plant or a part thereof an increased expression of: an miRNA selected from SEQ ID NOs: 12, 25 and 34 and/or the gene of SEQ ID NO: 196, wherein compared to the host soybean plant or a part thereof used to produce the elite soybean plant or a part thereof, the elite soybean plant or a part thereof exhibits an increased resistance to an SCN infection.

9. The method of claim 8, said method produces an SCN resistant elite soybean plant.

10. The method of claim 8, wherein said method further comprises introducing into said soybean plant one or more traits selected from the group consisting of herbicide tolerance, increased yield, insect control, fungal disease resistance, virus resistance, nematode resistance, bacterial disease resistance, mycoplasma disease resistance, modified oils production, high oil production, high protein production, germination and seedling growth control, enhanced animal and human nutrition, lower raffinose, environmental stress resistance, increased digestibility, improved processing traits, improved flavor, improved nitrogen fixation, improved hybrid seed production, reduced allergenicity, and improved production of biofuels.

11. The method of claim 10, wherein said soybean plant produced by said method is resistant to a herbicide selected from the group consisting of glyphosate, dicamba, glufosinate, sulfonylurea, bromoxynil, 2,4-Dichlorophenoxyacetic acid, and norflurazon.

12. The method of claim 8, wherein said soybean plant produced by said method is transgenic.

13. The elite soybean plant, or part thereof, of claim 1, wherein said elite soybean plant comprises:
   i) a heterologous nucleic acid sequence encoding the miRNA of SEQ ID NO: 12, or
   ii) a native nucleic acid sequence encoding the miRNA of SEQ ID NO: 12 operably linked to a heterologous promoter.

14. The elite soybean plant, or part thereof, of claim 1, wherein said elite soybean plant comprises:
   i) a heterologous nucleic acid sequence encoding the miRNA of SEQ ID NO: 25, or
   ii) a native nucleic acid sequence encoding the miRNA of SEQ ID NO: 25 operably linked to a heterologous promoter.

15. The elite soybean plant, or part thereof, of claim 1, wherein said elite soybean plant comprises:
   i) a heterologous nucleic acid sequence encoding the miRNA of SEQ ID NO: 34, or
   ii) a native nucleic acid sequence encoding the miRNA of SEQ ID NO: 34 operably linked to a heterologous promoter.

16. The elite soybean plant, or part thereof, of claim 1, wherein said elite soybean plant comprises:
   i) a heterologous nucleic acid sequence encoding the gene of SEQ ID NO: 196, or
   ii) a native nucleic acid sequence encoding the gene of SEQ ID NO: 196 operably linked to a heterologous promoter.

* * * * *